US011760981B2

(12) United States Patent
Vroom et al.

(10) Patent No.: US 11,760,981 B2
(45) Date of Patent: Sep. 19, 2023

(54) ENGINEERED GLYCOSYLTRANSFERASES AND STEVIOL GLYCOSIDE GLUCOSYLATION METHODS

(71) Applicants: Codexis, Inc., Redwood City, CA (US); Tate & Lyle Ingredients Americas LLC, Hoffman Estates, IL (US)

(72) Inventors: Jonathan Vroom, South San Francisco, CA (US); Stephanie Sue Galanie, Knoxville, TN (US); Jack Liang, San Mateo, CA (US); Joyce Liu, Fremont, CA (US); Nikki Dellas, Mountain View, CA (US); Melissa Ann Mayo, Foster City, CA (US); David Entwistle, San Carlos, CA (US)

(73) Assignee: Codexis, Inc., Redwood City, CA (US)

(*) Notice: Subject to any disclaimer, the term of this patent is extended or adjusted under 35 U.S.C. 154(b) by 1024 days.

(21) Appl. No.: 16/514,578

(22) Filed: Jul. 17, 2019

(65) Prior Publication Data

US 2020/0032227 A1 Jan. 30, 2020

Related U.S. Application Data

(60) Provisional application No. 62/712,327, filed on Jul. 31, 2018, provisional application No. 62/712,199, filed on Jul. 30, 2018.

(51) Int. Cl.
*C12N 9/10* (2006.01)
*C07H 15/252* (2006.01)
*C12P 19/56* (2006.01)

(52) U.S. Cl.
CPC .......... *C12N 9/1062* (2013.01); *C07H 15/252* (2013.01); *C12N 9/1048* (2013.01); *C12P 19/56* (2013.01); *C12Y 204/01013* (2013.01)

(58) Field of Classification Search
CPC .................................................. C12N 9/1062
See application file for complete search history.

(56) References Cited

U.S. PATENT DOCUMENTS

| | | | |
|---|---|---|---|
| 5,605,793 A | 2/1997 | Stemmer | |
| 5,811,238 A | 9/1998 | Stemmer et al. | |
| 5,830,721 A | 11/1998 | Stemmer et al. | |
| 5,834,252 A | 11/1998 | Stemmer et al. | |
| 5,837,458 A | 11/1998 | Minshull et al. | |
| 5,928,905 A | 7/1999 | Stemmer et al. | |
| 6,096,548 A | 8/2000 | Stemmer | |
| 6,117,679 A | 9/2000 | Stemmer | |
| 6,132,970 A | 10/2000 | Stemmer | |
| 6,165,793 A | 12/2000 | Stemmer | |
| 6,180,406 B1 | 1/2001 | Stemmer | |
| 6,251,674 B1 | 6/2001 | Tobin et al. | |
| 6,265,201 B1 | 7/2001 | Wackett et al. | |
| 6,277,638 B1 | 8/2001 | Stemmer | |
| 6,287,861 B1 | 9/2001 | Stemmer et al. | |
| 6,287,862 B1 | 9/2001 | delCardayre et al. | |
| 6,291,242 B1 | 9/2001 | Stemmer | |
| 6,297,053 B1 | 10/2001 | Stemmer | |
| 6,303,344 B1 | 10/2001 | Patten et al. | |
| 6,309,883 B1 | 10/2001 | Minshull et al. | |
| 6,319,713 B1 | 11/2001 | Patten et al. | |
| 6,319,714 B1 | 11/2001 | Crameri et al. | |
| 6,323,030 B1 | 11/2001 | Stemmer | |
| 6,326,204 B1 | 12/2001 | delCardayre et al. | |
| 6,335,160 B1 | 1/2002 | Patten et al. | |
| 6,335,198 B1 | 1/2002 | delCardayre et al. | |
| 6,337,186 B1 | 1/2002 | Krebber | |
| 6,344,356 B1 | 2/2002 | Stemmer | |
| 6,352,859 B1 | 3/2002 | delCardayre et al. | |
| 6,355,484 B1 | 3/2002 | Patten et al. | |
| 6,358,740 B1 | 3/2002 | Patten et al. | |
| 6,358,742 B1 | 3/2002 | Stemmer | |
| 6,365,377 B1 | 4/2002 | Patten et al. | |
| 6,365,408 B1 | 4/2002 | Stemmer | |

(Continued)

FOREIGN PATENT DOCUMENTS

| | | |
|---|---|---|
| WO | 95/22625 A1 | 8/1995 |
| WO | 95/33836 A1 | 12/1995 |

(Continued)

OTHER PUBLICATIONS

Altschul, S., et al., "Basic local alignment search tool," J. Mol. Biol., 215: 403-410 (1990).
Altschul, S.F., et al., "Gapped BLAST and PSI-BLAST: a new generation of protein database search programs," Nucleic Acids Res., 25(17):3389-3402 (1997).
Ameyama, M., et al., "D-Fructose Dehydrogenase of Gluconobacter industrius: Purification, Characterization, and Application to Enzymatic Microdetermination of D-Fructose," J. Bacteriol., 145(2):814-823 [1981].
Ameyama, M., "{4} Enzymic microdetermination of d-glucose, d-fructose, d-gluconate, 2-keto-d-gluconate, aldehyde, and alcohol with membrane-bound dehydrogenases," Meth. Enzymol., 89:20-29 [1982].

(Continued)

*Primary Examiner* — Suzanne M Noakes
(74) *Attorney, Agent, or Firm* — Codexis, Inc.

(57) ABSTRACT

The present invention provides engineered glycosyltransferase (GT) enzymes, polypeptides having GT activity, and polynucleotides encoding these enzymes, as well as vectors and host cells comprising these polynucleotides and polypeptides. The present invention provides engineered sucrose synthase (SuS) enzymes, polypeptides having SuS activity, and polynucleotides encoding these enzymes, as well as vectors and host cells comprising these polynucleotides and polypeptides. The present invention also provides compositions comprising the GT enzymes and methods of using the engineered GT enzymes to make products with β-glucose linkages. The present invention further provides compositions and methods for the production of rebaudiosides (e.g., rebaudioside M, rebaudioside A, rebaudioside I, and rebaudioside D). The present invention also provides compositions comprising the SuS enzymes and methods of using them. Methods for producing GT and SuS enzymes are also provided.

20 Claims, 3 Drawing Sheets

Specification includes a Sequence Listing.

(56) References Cited

U.S. PATENT DOCUMENTS

| | | |
|---|---|---|
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,605,430 B1 | 7/2003 | Affholter et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selifonov et al. |
| 6,946,296 B2 | 9/2005 | Patten et al. |
| 6,961,664 B2 | 11/2005 | Selifonov et al. |
| 6,995,017 B1 | 2/2006 | Stemmer |
| 7,024,312 B1 | 4/2006 | Selifonov et al. |
| 7,058,515 B1 | 6/2006 | Selifonov et al. |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selifonov et al. |
| 7,430,477 B2 | 9/2008 | Selifonov et al. |
| 7,462,469 B2 | 12/2008 | Bass et al. |
| 7,534,564 B2 | 5/2009 | Patten et al. |
| 7,620,500 B2 | 11/2009 | Mundorff et al. |
| 7,620,502 B2 | 11/2009 | Selifonov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selifonov et al. |
| 7,868,138 B2 | 1/2011 | Stemmer et al. |
| 7,873,477 B1 | 1/2011 | Gustafsson et al. |
| 7,873,499 B2 | 1/2011 | Selifonov et al. |
| 7,904,249 B2 | 3/2011 | Selifonov et al. |
| 7,957,912 B2 | 6/2011 | Selifonov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selifonov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selifonov et al. |
| 8,762,066 B2 | 6/2014 | Fox |
| 8,768,871 B2 | 7/2014 | Fox |
| 9,593,326 B2 | 3/2017 | Clark et al. |
| 9,665,694 B2 | 5/2017 | Cope |
| 9,684,771 B2 | 6/2017 | Cope et al. |
| 9,714,437 B2 | 7/2017 | Chan et al. |
| 2006/0195947 A1 | 8/2006 | Davis et al. |
| 2008/0104724 A1 | 5/2008 | Sticken et al. |
| 2008/0220990 A1 | 9/2008 | Fox |
| 2009/0312196 A1 | 12/2009 | Colbeck et al. |
| 2018/0223264 A1 | 8/2018 | Vroom et al. |

FOREIGN PATENT DOCUMENTS

| | | |
|---|---|---|
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 00/42651 A1 | 7/2000 |
| WO | 01/75767 A2 | 10/2001 |
| WO | 2009/015268 A2 | 1/2009 |
| WO | 2009/152336 A1 | 12/2009 |
| WO | 2013/176738 A1 | 11/2013 |
| WO | 2016/168413 A1 | 10/2016 |
| WO | 2017/207484 A1 | 12/2017 |
| WO | 2017/218324 A1 | 12/2017 |
| WO | 2018/144679 A2 | 8/2018 |

OTHER PUBLICATIONS

Baldino, Jr., F., et al., "High-Resolution in Situ Hybridization Histochemistry," Methods Enzymology, 168:761-777 (1989).

Batzer, M.A., "Erratum: Structure and variability of recently inserted Alu family members", Nucleic Acids Res 19:698-699 [1991].

Bolton, E.T., et al., "A General Method for the Iisolation of RNA Complementary to DNA," Proc. Natl. Acad. Sci. USA 48:1390 (1962).

Botstein, D., et al., "Strategies and applications of in vitro mutagenesis," Science, 229(4719):1193-1201, 1985.

Breslauer, K.J., et al., "Predicting DNA duplex stability from the base sequence," Proc. Natl. Acad. Sci. USA, 83:3746-3750 (1986).

Carter, P., "Site-directed mutagenesis," Biochem. J., 237:1-7 (1986).

Christians, F.C., et al., "Directed evolution of thymidine kinase for AZT phosphorylation using DNA family shuffling," Nat. Biotechnol., 17:259-264 (1999).

Crameri, A., et al., "DNA shuffling of a family of genes from diverse species accelerates directed evolution", Nature, 391:288-291 (1998).

Crameri, A., et al., "Improved green fluorescent protein by molecular evolution using DNA shuffling," Nat. Biotechnol., 14(3):315-319 (1996).

Crameri, A., et al., "Molecular evolution of an arsenate detoxification pathway by DNA shuffling," Nat. Biotechnol., 15(5):436-438 (1997).

Dale, S.J., et al., "Oligonucleotide-directed random mutagenesis using the phosphorothioate method," Methods Mol. Biol., 57:369-74 (1996).

De Boer, H.A., et al., "The tac promoter: a functional hybrid derived from the trp and lac promoters," Proc. Natl Acad. Sci. USA, 80:21-25 (1983).

(56) References Cited

OTHER PUBLICATIONS

Freier, S.M., et al., "Improved free-energy parameters for predictions of RNA duplex stability," Proc. Natl. Acad. Sci USA, 83:9373-9377 (1986).
Guo, Z., et al., "3'-End-Forming Signals of Yeast mRNA," Mol. Cell. Biol., 15(11):5983-5990 [1995].
Henaut and Danchin in Neidhardt et al. [eds.], *Escherichia coli* and *Salmonella*, "Analysis and predictions from *Escherichia coli* Sequences, or *E. coli* in silico," ASM Press, Washington D.C., [1987], pp. 2047-2066.
Henikoff, S., et al., "Amino acid substitution matrices from protein blocks," Proc. Natl. Acad. Sci. USA, 89:10915-10919 [1992].
Kasai, R., et al., "Sweet Diterpene-Glycosides of Leaves of Stevia rebaudiana Bertoni—Synthesis and Structure-Sweetness Relationship of Rebaudiosides-A,-D,-E and Their Related Glycosides," Nippon Kagaku Kaishi, The Chemical Society, 1981(5):726-735 [1981].
Kierzek, R., et al., "Polymer-Supported RNA Synthesis and Its Application to Test the Nearest-Neighbor Model for Duplex Stability," Biochemistry, 25:7840-7846 (1986).
Kramer, B., et al., "Different base/base mismatches are corrected with different efficiencies by the methyl-directed DNA mismatch-repair system of *E. coli*," Cell, 38(3):879-887 [1984].
Lairson, L.L., et al.,"Glycosyltransferases: Structures, Functions, and Mechanisms," Ann. Rev. Biochem., 77:521-555 [2008].
Ling, M.M., et al., "Approaches to DNA Mutagenesis: an Overview," Anal. Biochem., 254(2):157-78 [1997].
McInerney, J.O., "GCUA: general codon usage analysis," Bioinformatics, 14(4):372-73 [1998].
Minshull, J., et al., "Protein evolution by molecular breeding," Curr. Op. Chem. Biol., 3(3):284-290 (1999).
Nakamura, Y., et al., "Codon usage tabulated from international DNA sequence databases: status for the year 2000," Nucl. Acids Res., 28:292 [2000].
Needleman, S., et al., "A general method applicable to the search for similarities in the amino acid sequence of two proteins," J. Mol. Biol. 48:443-453 (1970).
Pearson, W.R., "Improved tools for biological sequence comparison," Proc. Nat'l. Acad. Sci. USA, 85:2444-2448 (1988).
Prakash, I., et al., "Development of Next Generation Stevia Sweetener: Rebaudioside M," Foods, 3:162-175 [2014].
Richman, A., et al., "Functional genomics uncovers three glucosyltransferases involved in the synthesis of the major sweet glucosides of Stevia rebaudiana," Plant J., 41:56-67 [2005].
Romanos, M.A., et al., "Foreign gene expression in yeast: a review," Yeast 8:423-488 [1992].
Rychlik, W., et al., "Optimization of the annealing temperature for DNA amplification in vitro," Nucleic Acids Res, 18(21):6409-6412 (1990).
Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).
Smith, T., et al., "Comparison of Biosequences," Adv. Appl. Math, 2:482-489 (1981).
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).
Stenico, M., et al., "Codon usage in Caenorhabditis elegans: delineation of translational selection and mutational biases," Nucl. Acids Res. 22(13):2437-46 [1994].
Suggs, S.V., et al., "Use of synthetic oligodeoxyribonucleotides for the isolation of specific cloned DNA sequences," in Developmental Biology Using Purified Genes (Brown et al., eds.), pp. 683-693, Academic Press (1981).
Tiwari, S., et al., "Prediction of probable genes by Fourier analysis of genomic sequences," Comput. Appl. Biosci. 13(3):263-270 [1997].
Uberbacher, E.C., et al., "Discovering and Understanding Genes in Human DNA Sequence Using GRAIL," Methods Enzymol., 266:259-281 [1996].
Villa-Komaroff, L., et al., "A bacterial clone synthesizing proinsulin," Proc. Natl Acad. Sci. USA, 75:3727-3731 (1978).
Wada, K., et al., "Codon usage tabulated from the GenBank genetic sequence data," Nucl. Acids Res., 20:2111-2118 [1992].
Wells, J.A., et al., "Cassette mutagenesis: an efficient method for generation of multiple mutations at defined sites," Gene, 34:315-323 (1985).
Wetmur, J. G., "DNA Probes: Applications of the Principles of Nucleic Acid Hybridization," Crit Rev Biochem Mol Biol, 26(¾):227-259 (1991).
Wright, F., "The 'effective number of codons' used in a gene," Gene 87:23-29 [1990].
Zhang, J-H., et al., "Directed evolution of a fucosidase from a galactosidase by DNA shuffling and screening, "Proc. Nat. Acad. Sci., U.S.A., 94:4504-4509 (1997).
Diricks, M., et al., "Identification of sucrose synthase in nonphotosynthetic bacteria and characterization of the recombinant enzymes," App. Microbiol. Biotechnol., 99:8465-8474 [2015].

УС 11,760,981 B2

ENGINEERED GLYCOSYLTRANSFERASES AND STEVIOL GLYCOSIDE GLUCOSYLATION METHODS

The present application claims priority to U.S. Prov. Pat. Appln. Ser. No. 62/712,199, filed Jul. 30, 2018, and U.S. Prov. Pat. Appln. Ser. No. 62/712,327, filed Jul. 31, 2018, both of which are hereby incorporated by reference in their entireties, for all purposes.

FIELD OF THE INVENTION

The present invention provides engineered glycosyltransferase (GT) enzymes, polypeptides having GT activity, and polynucleotides encoding these enzymes, as well as vectors and host cells comprising these polynucleotides and polypeptides. The present invention provides engineered sucrose synthase (SuS) enzymes, polypeptides having SuS activity, and polynucleotides encoding these enzymes, as well as vectors and host cells comprising these polynucleotides and polypeptides. The present invention also provides compositions comprising the GT enzymes and methods of using the engineered GT enzymes to make products with β-glucose linkages. The present invention further provides compositions and methods for the production of rebaudiosides (e.g., rebaudioside M, rebaudioside A, rebaudioside I, and rebaudioside D). The present invention also provides compositions comprising the SuS enzymes and methods of using them. Methods for producing GT and SuS enzymes are also provided.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX8-180USP1A_ST25.txt", a creation date of Jul. 31, 2018, and a size of 8,929 kilobytes. The Sequence Listing filed via EFS-Web is part of the specification and is incorporated in its entirety by reference herein.

BACKGROUND OF THE INVENTION

Glycosyltransferases (GT) are enzymes that post-translationally transfer glycosyl residues from an activated nucleoside sugar to monomeric and polymeric acceptor molecules (e.g., other sugars, proteins, lipids, and other organic substrates). Thus, these enzymes utilize an activated donor sugar substrate that contains a substituted phosphate leaving group. Donor sugar substrates (i.e., the "glycosyl donor") are commonly activated as nucleoside diphosphate sugars. However, other sugars, such as nucleoside monophosphate sugars, lipid phosphates and unsubstituted phosphates are also used (See e.g., Lairson et al., Ann. Rev. Biochem., 77:25.1-25.35 [2008]). GTs are classified as either retaining or inverting enzymes, based on the stereochemistry of the substrates and reaction products. In reactions where the stereochemistry of the donor's anomeric bond is retained (e.g., alpha to alpha), the GT is a retaining enzyme. In reactions where the stereochemistry is inverted (e.g., alpha to beta), the GT is an inverting enzyme. These glycosylated products are involved in various metabolic pathways and processes. Indeed, the biosynthesis of numerous disaccharides, oligosaccharides, and polysaccharides involve the action of various glycosyltransferases. The transfer of a glucosyl moiety can alter the acceptor's bioactivity, solubility, and transport properties within cells. GTs have found use in the targeted synthesis of specific compounds (e.g., glycoconjugates and glycosides), as well as the production of differentially glycosylated drug, biological probes or natural product libraries. In some methods, the large scale use of GTs for glycoconjugate synthesis requires large quantities of glycosyl donors, adding to the cost of such approaches. Nucleotide recycling systems have been developed to allow the resynthesis of glycosyl donors from the released nucleotide. These recycling systems also reduce the amount of nucleotide by-product formed during the reaction, thereby reducing inhibition caused by the GT. Nonetheless, the need remains for improved methods suitable for large-scale production of glycoconjugates by GTs.

SUMMARY OF THE INVENTION

The present invention provides engineered glycosyltransferase (GT) enzymes, polypeptides having GT activity, and polynucleotides encoding these enzymes, as well as vectors and host cells comprising these polynucleotides and polypeptides. The present invention provides engineered sucrose synthase (SuS) enzymes, polypeptides having SuS activity, and polynucleotides encoding these enzymes, as well as vectors and host cells comprising these polynucleotides and polypeptides. The present invention also provides compositions comprising the GT enzymes and methods of using the engineered GT enzymes to make products with β-glucose linkages. The present invention further provides compositions and methods for the production of rebaudiosides (e.g., rebaudioside M, rebaudioside A, rebaudioside I, and rebaudioside D). The present invention also provides compositions comprising the SuS enzymes and methods of using them. Methods for producing GT and SuS enzymes are also provided.

The present invention provide engineered glycosyltransferase variants comprising polypeptide sequences that have at least 90%, 91%, 92%, 93%, 94%, 95%, 96%, 97%, 98%, 99%, or more sequence identity to SEQ ID NO: 2. In some embodiments, the engineered glycosyltransferase comprises a polypeptide that is at least 95%, 96%, 97%, 98%, 99%, or more sequence identity to SEQ ID NO: 20. In some additional embodiments, the polypeptide sequence of the engineered glycosyltransferase comprises at least one mutation or mutation set at one or more positions selected from 41/72/233/338, 41/72/338, 41/144/233, 41/233, 41/233/338, 61, 61/87/91/107, 61/87/91/259, 61/91/431, 61/107, 61/259/428, 61/407/428, 61/411, 72, 72/76, 72/76/163/197, 72/76/195/233, 72/76/197/204, 72/76/207/233, 72/76/207/338, 72/81, 72/81/195/233, 72/139/195/204, 72/144/338, 72/200/204/207, 72/207, 76/144/197/200, 76/195/197/204/207/233, 76/197/207/233, 76/233, 81/139/144/195/200/204/207/233, 81/144/233, 81/197/200/207/233/338, 81/233/338, 81/338, 107, 107/259, 139/144/233, 144/233, 144/233/338, 156/407, 163/233/338, 200/204/207/233, 233/338, and 259, wherein the positions are numbered with reference to SEQ ID NO: 20. In some additional embodiments, the polypeptide sequence of the engineered glycosyltransferase comprises at least one mutation or mutation set selected from 41E/72P/233Q/338A, 41E/72P/338A, 41E/144Q/233T, 41E/233Q, 41E/233Q/338V, 41E/233T, 41E/233T/338V, 61D, 61D/87K/91L/107L, 61D/87K/91L/259T, 61D/107V, 61D/259T/428I, 61D/407T/428I, 61E/87K/91L/107V, 61E/91L/431M, 61E/411T, 72P, 72P/76S, 72P/76S/163A/197K, 72P/76S/207V/338V, 72P/76T, 72P/76T/195Q/233T, 72P/76T/197K/204T, 72P/76T/207V/233Q, 72P/81T, 72P/81T/195Q/233Q, 72P/139N/195Q/204T, 72P/144Q/338V, 72P/200R/204T/

207V, 72P/207V, 76S/144Q/197K/200R, 76S/195Q/197K/ 204T/207V/233T, 76S/197K/207V/233Q, 76S/233T, 81T/ 139N/144Q/195Q/200R/204T/207V/233Q, 81T/144Q/ 233Q, 81T/197K/200R/207V/233Q/338A, 81T/233Q/338V, 81T/338V, 107V, 107V/259T, 139N/144Q/233Q, 144Q/ 233T, 144Q/233T/338V, 156S/407T, 163A/233T/338A, 200R/204T/207V/233T, 233Q/338V, and 259T, wherein the positions are numbered with reference to SEQ ID NO: 20. In some additional embodiments, the polypeptide sequence of the engineered glycosyltransferase comprises at least one mutation or mutation set selected from A41E/T72P/W233Q/ C338A, A41E/T72P/C338A, A41E/M144Q/W233T, A41E/ W233Q, A41E/W233Q/C338V, A41E/W233T, A41E/ W233T/C338V, Q61D, Q61D/A87K/Q91L/A107L, Q61D/ A87K/Q91L/E259T, Q61D/A107V, Q61D/E259T/K428I, Q61D/I407T/K428I, Q61E/A87K/Q91L/A107V, Q61E/ Q91L/D431M, Q61E/R411T, T72P, T72P/R76S, T72P/ R76S/L163A/Q197K, T72P/R76S/I207V/C338V, T72P/ R76T, T72P/R76T/H195Q/W233T, T72P/R76T/Q197K/ D204T, T72P/R76T/I207V/W233Q, T72P/H81T, T72P/ H81T/H195Q/W233Q, T72P/K139N/H195Q/D204T, T72P/ M144Q/C338V, T72P/K200R/D204T/I207V, T72P/I207V, R76S/M144Q/Q197K/K200R, R76S/H195Q/Q197K/ D204T/I207V/W233T, R76S/Q197K/I207V/W233Q, R76S/W233T, H81T/K139N/M144Q/H195Q/K200R/ D204T/I207V/W233Q, H81T/M144Q/W233Q, H81T/ Q197K/K200R/I207V/W233Q/C338A, H81T/W233Q/ C338V, H81T/C338V, A107V, A107V/E259T, K139N/ M144Q/W233Q, M144Q/W233T, M144Q/W233T/C338V, C156S/I407T, L163A/W233T/C338A, K200R/D204T/ I207V/W233T, W233Q/C338V, and E259T, wherein the positions are numbered with reference to SEQ ID NO: 20.

In some further embodiments, the polypeptide sequence of the engineered glycosyltransferase comprises at least one mutation or mutation set at one or more positions selected from 71, 80, 81, 81/270, 83, 85, 97, 124, 263, 286, 334, 402, 420, and 456, wherein the positions are numbered with reference to SEQ ID NO: 20. In some additional embodiments, the polypeptide sequence of the engineered glycosyltransferase comprises at least one mutation or mutation set selected from 71G, 71T, 80D, 80P, 80Q, 81A, 81L, 81M, 81S, 81T, 81V, 81V/270K, 83D, 85T, 85V, 97V, 124P, 263C, 286L, 334V, 402I, 420R, and 456K, wherein the positions are numbered with reference to SEQ ID NO: 20. In some additional embodiments, the polypeptide sequence of the engineered glycosyltransferase comprises at least one mutation or mutation set selected from Q71G, Q71T, T80D, T80P, T80Q, H81A, H81L, H81M, H81S, H81T, H81V, H81V/Q270K, P83D, A85T, A85V, A97V, A124P, T263C, V286L, I334V, E402I, E420R, and S456K, wherein the positions are numbered with reference to SEQ ID NO: 20.

In some additional embodiments, the polypeptide sequence of the engineered glycosyltransferase comprises at least one mutation or mutation set at one or more positions selected from 41/72/233/338, 41/72/338, 61, 61/91/431, 61/259/428, 61/407/428, wherein the positions are numbered with reference to SEQ ID NO: 20. In some additional embodiments, the polypeptide sequence of the engineered glycosyltransferase comprises at least one mutation or mutation set selected from 41E/72P/233Q/338A, 41E/72P/338A, 61D, 61D/259T/428I, 61D/407T/428I, 61E/91L/431M, 81T/139N/144Q/195Q/200R/204T/207V/233Q, and 81T/ 197K/200R/207V/233Q/338A, wherein the positions are numbered with reference to SEQ ID NO: 20. In some additional embodiments, the polypeptide sequence of the engineered glycosyltransferase comprises at least one mutation or mutation set selected from A41E/T72P/W233Q/ C338A, A41E/T72P/C338A, Q61D, Q61D/E259T/K428I, Q61D/I407T/K428I, Q61E/Q91L/D431M, H81T/K139N/ M144Q/H195Q/K200R/D204T/I207V/W233Q, and H81T/ Q197K/K200R/I207V/W233Q/C338A, wherein the positions are numbered with reference to SEQ ID NO: 20.

In yet some further embodiments, the polypeptide sequence of the engineered glycosyltransferase comprises at least one mutation or mutation set at one or more positions selected from 73/81/144/207/259, 73/81/144/207/285/451, 73/81/259/285/426/451, 73/81/259/451, 73/111/285/451, 73/144/207/252/426/451, 73/144/207/259/285/426/451, 73/144/207/259/285/451, 73/144/207/259/426/451, 73/144/ 259/285, 73/259/426/451, 73/259/451, 81/111/144/207/285/ 451, 81/111/259/451, 81/144/207/252/285/426, 81/144/207/ 259/451, 81/144/252/259/285/451, 81/144/259, 81/144/259/ 285, 81/144/259/451, 81/207/252/259/451, 81/207/285/426/ 451, 81/285, 81/285/451, 111/144/207/252/285/426/451, 111/144/252/259/285/451, 111/144/259/285/426/451, 111/ 207/285, 144/207/252/259, 144/207/259, 144/207/259/285/ 451, 144/207/259/426/451, 144/207/285/426, 144/207/451, 144/252/259/285, 144/252/259/285/451, 144/252/259/426, 144/252/259/426/451, 144/259/285, 144/285, 144/285/451, 144/451, 207, 207/252/259/451, 207/252/451, 207/259, 207/ 259/426/451, 207/285/426/451, 207/451, 252/259, 259, 259/ 285/451, 285, and 285/451, wherein the positions are numbered with reference to SEQ ID NO: 36.

In some additional embodiments, the polypeptide sequence of the engineered glycosyltransferase comprises at least one mutation or mutation set selected from 73S/81T/ 144Q/207V/259T, 73S/81T/144Q/207V/285S/451Q, 73S/ 81T/259T/285S/426I/451Q, 73S/81T/259T/451Q, 73S/ 111T/285S/451Q, 73S/144Q/207V/252P/426I/451Q, 73S/ 144Q/207V/259T/285S/426I/451Q, 73S/144Q/207V/259T/ 285S/451Q, 73S/144Q/207V/259T/426I/451Q, 73S/144Q/ 259T/285S, 73S/259T/426I/451Q, 73S/259T/451Q, 81T/ 111T/144Q/207V/285S/451Q, 81T/111T/259T/451Q, 81T/ 144Q/207V/252P/285S/426I, 81T/144Q/207V/259T/451Q, 81T/144Q/252P/259T/285S/451Q, 81T/144Q/259T, 81T/ 144Q/259T/285S, 81T/144Q/259T/451Q, 81T/207V/252P/ 259T/451Q, 81T/207V/285S/426I/451Q, 81T/285S, 81T/ 285S/451Q, 111T/144Q/207V/252P/285S/426I/451Q, 111T/144Q/252P/259T/285S/451Q, 111T/144Q/259T/ 285S/426I/451Q, 111T/207V/285S, 144Q/207V/252P/ 259T, 144Q/207V/259T, 144Q/207V/259T/285S/451Q, 144Q/207V/259T/426I/451Q, 144Q/207V/285S/426I, 144Q/207V/451Q, 144Q/252P/259T/285S, 144Q/252P/ 259T/285S/451Q, 144Q/252P/259T/426I, 144Q/252P/ 259T/426I/451Q, 144Q/259T/285S, 144Q/285S, 144Q/ 285S/451Q, 144Q/451Q, 207V, 207V/252P/259T/451Q, 207V/252P/451Q, 207V/259T, 207V/259T/426I/451Q, 207V/285S/426I/451Q, 207V/451Q, 252P/259T, 259T, 259T/285S/451Q, 285S, and 285S/451Q, wherein the positions are numbered with reference to SEQ ID NO: 36. In some additional embodiments, the polypeptide sequence of the engineered glycosyltransferase comprises at least one mutation or mutation set selected from E73S/H81T/M144Q/ I207V/E259T, E73S/H81T/M144Q/I207V/E285S/V451Q, E73S/H81T/E259T/E285S/A426I/V451Q, E73S/H81T/ E259T/V451Q, E73S/S111T/E285S/V451Q, E73S/M144Q/ I207V/S252P/A426I/V451Q, E73S/M144Q/I207V/E259T/ E285S/A426I/V451Q, E73S/M144Q/I207V/E259T/E285S/ V451Q, E73S/M144Q/I207V/E259T/A426I/V451Q, E73S/ M144Q/E259T/E285S, E73S/E259T/A426I/V451Q, E73S/ E259T/V451Q, H81T/S111T/M144Q/I207V/E285S/ V451Q, H81T/S111T/E259T/V451Q, H81T/M144Q/ I207V/S252P/E285S/A426I, H81T/M144Q/I207V/E259T/ V451Q, H81T/M144Q/S252P/E259T/E285S/V451Q, H81T/M144Q/E259T, H81T/M144Q/E259T/E285S, H81T/ M144Q/E259T/V451Q, H81T/I207V/S252P/E259T/ V451Q, H81T/I207V/E285S/A426I/V451Q, H81T/E285S, H81T/E285S/V451Q, S111T/M144Q/I207V/S252P/E285S/ A426I/V451Q, S111T/M144Q/S252P/E259T/E285S/ V451Q, S111T/M144Q/E259T/E285S/A426I/V451Q, S111T/I207V/E285S, M144Q/I207V/S252P/E259T, M144Q/I207V/E259T, M144Q/I207V/E259T/E285S/ V451Q, M144Q/I207V/E259T/A426I/V451Q, M144Q/ I207V/E285S/A426I, M144Q/I207V/V451Q, M144Q/ S252P/E259T/E285S, M144Q/S252P/E259T/E285S/ V451Q, M144Q/S252P/E259T/A426I, M144Q/S252P/ E259T/A426I/V451Q, M144Q/E259T/E285S, M144Q/ E285S, M144Q/E285S/V451Q, M144Q/V451Q, I207V, I207V/S252P/E259T/V451Q, I207V/S252P/V451Q, I207V/E259T, I207V/E259T/A426I/V451Q, I207V/E285S/ A426I/V451Q, I207V1V451Q, S252P/E259T, E259T, E259T/E285S/V451Q, E285S, and E285S/V451Q, wherein the positions are numbered with reference to SEQ ID NO: 36. In yet some further embodiments, the polypeptide sequence of the engineered glycosyltransferase comprises at least one mutation or mutation set at one or more positions selected from 81/111/144/207/285/451, 144/207/252/259, 144/207/259/285/451, 144/252/259/426, 144/252/259/426/ 451, and 144/285/451, wherein the positions are numbered with reference to SEQ ID NO: 36. In some additional embodiments, the polypeptide sequence of the engineered glycosyltransferase comprises at least one mutation or mutation set selected from 81T/111T/144Q/207V/285S/451Q, 144Q/207V/252P/259T, 144Q/207V/259T/285S/451Q, 144Q/252P/259T/426I, 144Q/252P/259T/426I/451Q, and 144Q/285S/451Q, wherein the positions are numbered with reference to SEQ ID NO: 36. In some additional embodiments, the polypeptide sequence of the engineered glycosyltransferase comprises at least one mutation or mutation set selected from H81T/S111T/M144Q/I207V/E285S/ V451Q, M144Q/I207V/S252P/E259T, M144Q/I207V/ E259T/E285S/V451Q, M144Q/S252P/E259T/A426I, M144Q/S252P/E259T/A426I/V451Q, and M144Q/E285S/ V451Q, wherein the positions are numbered with reference to SEQ ID NO: 36.

In yet some further embodiments, the polypeptide sequence of the engineered glycosyltransferase comprises at least one mutation or mutation set at one or more positions selected from 80/81, 80/81/85, 80/81/85/238, 80/81/85/251/ 259, 80/81/85/252/256/259, 80/81/85/259, 80/81/251/252/ 259, 80/85, 80/85/238, 80/85/238/251/259, 80/85/251, 80/85/251/252, 80/85/251/252/256/259, 80/85/251/252/259, 80/85/251/259, 80/85/259, 80/259, 81/85, 81/85/251/252, 81/85/259, 85, 85/238, 85/251, 85/251/252/256, 85/251/259, 85/256/259, 175/402, 251/252/259, 259, 270/402, and 420, wherein the positions are numbered with reference to SEQ ID NO: 174. In some additional embodiments, the polypeptide sequence of the engineered glycosyltransferase comprises at least one mutation or mutation set selected from 80D/81A, 80D/81A/85V, 80D/81A/85V/238G, 80D/81A/ 85V/251M/259T, 80D/81A/85V/252P/256G/259T, 80D/ 85V, 80D/85V/238G, 80D/85V/238G/251M/259T, 80D/ 85V/251I/252P/256G/259T, 80D/85V/251I/259T, 80D/ 85V/251M, 80D/85V/251M/252P, 80D/85V/251M/252P/ 256G/259T, 80D/85V/259T, 80D/259T, 80P/81A/85V/ 259T, 80P/81A/251I/252P/259T, 80P/85V, 80P/85V/251M/ 252P/259T, 81A/85V, 81A/85V/251M/252P, 81A/85V/ 259T, 85V, 85V/238G, 85V/251F, 85V/251F/259T, 85V/ 251M/252P/256G, 85V/256G/259T, 175D/402I, 251I/252P/ 259T, 259T, 270K/402I, and 420R, wherein the positions are numbered with reference to SEQ ID NO: 174. In some additional embodiments, the polypeptide sequence of the engineered glycosyltransferase comprises at least one mutation or mutation set selected from T80D/T81A, T80D/T81A/ A85V, T80D/T81A/A85V/A238G, T80D/T81A/A85V/ A251M/E259T, T80D/T81A/A85V/S252P/L256G/E259T, T80D/A85V, T80D/A85V/A238G, T80D/A85V/A238G/ A251M/E259T, T80D/A85V/A251I/S252P/L256G/E259T, T80D/A85V/A251I/E259T, T80D/A85V/A251M, T80D/ A85V/A251M/S252P, T80D/A85V/A251M/S252P/L256G/ E259T, T80D/A85V/E259T, T80D/E259T, T80P/T81A/ A85V/E259T, T80P/T81A/A251I/S252P/E259T, T80P/ A85V, T80P/A85V/A251M/S252P/E259T, T81A/A85V, T81A/A85V/A251M/S252P, T81A/A85V/E259T, A85V, A85V/A238G, A85V/A251F, A85V/A251F/E259T, A85V/ A251M/S252P/L256G, A85V/L256G/E259T, E175D/ E402I, A251I/S252P/E259T, E259T, Q270K/E402I, and E420R, wherein the positions are numbered with reference to SEQ ID NO: 174. In some embodiments, the polypeptide sequence of the engineered glycosyltransferase comprises at least one mutation or mutation set at one or more positions selected from 3, 5, 7, 99, 153, 232/317, 252, 273, 299, 326, 393, 404, 409, 422, 443, 451, and 455, wherein the positions are numbered with reference to SEQ ID NO: 174. In some additional embodiments, the polypeptide sequence of the engineered glycosyltransferase comprises at least one mutation or mutation set selected from 3S, 5A, 5H, 5L, 5T, 7A, 7Q, 99V, 153C, 232I/317L, 252A, 273K, 299M, 326A, 326E, 326N, 326S, 393I, 404M, 404V, 409S, 422I, 443A, 451E, 451V, 455M, and 455R, wherein the positions are numbered with reference to SEQ ID NO: 174. In some additional embodiments, the polypeptide sequence of the engineered glycosyltransferase comprises at least one mutation or mutation set selected from N3S, 5SA, S5H, S5L, 5ST, T7A, T7Q, E99V, A153C, V232I/Y317L, S252A, S273K, V299M, G326A, G326E, G326N, G326S, V393I, G404M, G404V, A409S, M422I, S443A, Q451E, Q451V, S455M, and S455R, wherein the positions are numbered with reference to SEQ ID NO: 174. In yet some further embodiments, the polypeptide sequence of the engineered glycosyltransferase comprises at least one mutation or mutation set at one or more positions selected from 80/81/85, 80/85, 80/85/251/ 259, 85, 85/251/252/256, 175/402, and 270/402, wherein the positions are numbered with reference to SEQ ID NO: 174. In some additional embodiments, the polypeptide sequence of the engineered glycosyltransferase comprises at least one mutation or mutation set selected from 80D/81A/85V, 80D/ 85V/251I/259T, 80P/85V, 85V, 85V/251M/252P/256G, 175D/402I, and 270K/402I, wherein the positions are numbered with reference to SEQ ID NO: 174. In some additional embodiments, the polypeptide sequence of the engineered glycosyltransferase comprises at least one mutation or mutation set selected from T80D/T81A/A85V, T80D/A85V/ A251I/E259T, T80P/A85V, A85V, A85V/A251M/S252P/ L256G, E175D/E402I, and Q270K/E402I, wherein the positions are numbered with reference to SEQ ID NO: 174.

In yet some further embodiments, the polypeptide sequence of the engineered glycosyltransferase comprises at least one mutation or mutation set at one or more positions selected from 81/85, 81/85/175/259/402, 81/85/251, 81/85/ 251/259, 81/85/259, 81/85/259/402, 85, 85/175, 85/175/251, 85/175/251/259/402, 85/175/259, 85/175/259/402, 85/175/ 402, 85/259, 85/259/402, and 85/402, wherein the positions are numbered with reference to SEQ ID NO: 406. In some additional embodiments, the polypeptide sequence of the engineered glycosyltransferase comprises at least one mutation or mutation set selected from 81A/85V, 81A/85V/175E/ 259T/402E, 81A/85V/251I, 81A/85V/251I/259T, 81A/85V/

259T, 81A/85V/259T/402E, 85V, 85V/175E, 85V/175E/251I, 85V/175E/251I/259T/402E, 85V/175E/259T, 85V/175E/259T/402E, 85V/175E/402E, 85V/259T, 85V/259T/402E, and 85V/402E, wherein the positions are numbered with reference to SEQ ID NO: 406. In some additional embodiments, the polypeptide sequence of the engineered glycosyltransferase comprises at least one mutation or mutation set selected from T81A/A85V, T81A/A85V/D175E/E259T/I402E, T81A/A85V/A251I, T81A/A85V/A251I/E259T, T81A/A85V/E259T, T81A/A85V/E259T/I402E, A85V, A85V/D175E, A85V/D175E/A251I, A85V/D175E/A251I/E259T/I402E, A85V/D175E/E259T, A85V/D175E/E259T/I402E, A85V/D175E/I402E, A85V/E259T, A85V/E259T/I402E, and A85V/I402E, wherein the positions are numbered with reference to SEQ ID NO: 406.

In yet some further embodiments, the polypeptide sequence of the engineered glycosyltransferase comprises at least one mutation or mutation set at one or more positions selected from 153, 153/326, 153/326/443, 153/326/443/455, 232, 232/273/299, 232/393/451, 299/451, 326, 404, and 451, wherein the positions are numbered with reference to SEQ ID NO: 408. In some additional embodiments, the polypeptide sequence of the engineered glycosyltransferase comprises at least one mutation or mutation set selected from 153C, 153C/326S, 153C/326S/443A, 153C/326S/443A/455M, 232I, 232I/273K/299M, 232I/393I/451E, 299M/451E, 326E, 326S, 404V, and 451E, wherein the positions are numbered with reference to SEQ ID NO: 408. In some additional embodiments, the polypeptide sequence of the engineered glycosyltransferase comprises at least one mutation or mutation set selected from A153C, A153C/G326S, A153C/G326S/S443A, A153C/G326S/S443A/S455M, V232I, V232I/S273K/V299M, V232I/V393I/Q451E, V299M/Q451E, G326E, G326S, G404V, and Q451E, wherein the positions are numbered with reference to SEQ ID NO: 408. In some further embodiments, the polypeptide sequence of the engineered glycosyltransferase comprises at least one mutation or mutation set at one or more positions selected from 25, 116, 146, 170, 173, 227, 296, 300, 315, 327, 330, 361, 408, 412, 438, 448, and 449, wherein the positions are numbered with reference to SEQ ID NO: 408. In some additional embodiments, the polypeptide sequence of the engineered glycosyltransferase comprises at least one mutation or mutation set selected from 25A, 116D, 116R, 116S, 146G, 170C, 170G, 170P, 170S, 170T, 173S, 227T, 296V, 300S, 315T, 327Y, 330G, 330T, 361C, 408C, 408T, 412A, 412K, 412S, 438Q, 448H, and 449S, wherein the positions are numbered with reference to SEQ ID NO: 408. In some additional embodiments, the polypeptide sequence of the engineered glycosyltransferase comprises at least one mutation or mutation set selected from L25A, E116D, E116R, E116S, S146G, D170C, D170G, D170P, D170S, D170T, R173S, S227T, R296V, A300S, K315T, F327Y, E330G, E330T, T361C, N408C, N408T, R412A, R412K, R412S, A438Q, E448H, and R449S, wherein the positions are numbered with reference to SEQ ID NO: 408. In some additional embodiments, the polypeptide sequence of the engineered glycosyltransferase comprises at least one mutation or mutation set at one or more positions selected from 153, 232, 232/393/451, and 451, wherein the positions are numbered with reference to SEQ ID NO: 408. In some additional embodiments, the polypeptide sequence of the engineered glycosyltransferase comprises at least one mutation or mutation set selected from 153C, 232I, 232I/393I/451E, and 451E, wherein the positions are numbered with reference to SEQ ID NO: 408. In some additional embodiments, the polypeptide sequence of the engineered glycosyltransferase comprises at least one mutation or mutation set selected from A153C, V232I, V232I/V393I/Q451E, and Q451E, wherein the positions are numbered with reference to SEQ ID NO: 408.

In some embodiments, the polypeptide sequence of the engineered glycosyltransferase comprises at least one mutation or mutation set at one or more positions selected from 146/170/196, 146/170/196/232, 146/170/196/232/423, 146/170/196/232/451/455, 146/170/196/408/451, 146/170/232, 146/170/232/423, 146/170/232/423/448/451/455, 146/170/259, 146/196, 146/196/232, 146/196/232/259/448/451, 146/196/455, 146/232/259/455, 146/232/315, 146/232/315/423/451/455, 146/232/326, 146/232/448, 146/232/451, and 146/413/451/455, wherein the positions are numbered with reference to SEQ ID NO: 440. In some additional embodiments, the polypeptide sequence of the engineered glycosyltransferase comprises at least one mutation or mutation set selected from 146G/170S/196I, 146G/170S/232I, 146G/170S/232I/423K/448H/451E/455M, 146G/170T/196I/232I, 146G/170T/196I/232I/423K, 146G/170T/196I/232I/451E/455R, 146G/170T/196I/408T/451E, 146G/170T/232I/423K, 146G/170T/259E, 146G/196I, 146G/196I/232I, 146G/196I/232I/259E/448H/451E, 146G/196I/455R, 146G/232I/259E/455M, 146G/232I/315S, 146G/232I/315S/423K/451E/455M, 146G/232I/326E, 146G/232I/448H, 146G/232I/451E, and 146G/413M/451E/455M, wherein the positions are numbered with reference to SEQ ID NO: 440. In some additional embodiments, the polypeptide sequence of the engineered glycosyltransferase comprises at least one mutation or mutation set selected from S146G/D170S/W196I, S146G/D170S/V232I, S146G/D170S/V232I/R423K/E448H/Q451E/S455M, S146G/D170T/W196I/V232I, S146G/D170T/W196I/V232I/R423K, S146G/D170T/W196I/V232I/Q451E/S455R, S146G/D170T/W196I/N408T/Q451E, S146G/D170T/V232I/R423K, S146G/D170T/T259E, S146G/W196I, S146G/W196I/V232I, S146G/W196I/V232I/T259E/E448H/Q451E, S146G/W196I/S455R, S146G/V232I/T259E/S455M, S146G/V232I/K315S, S146G/V232I/K315S/R423K/Q451E/S455M, S146G/V232I/G326E, S146G/V232I/E448H, S146G/V232I/Q451E, and S146G/V413M/Q451E/S455M, wherein the positions are numbered with reference to SEQ ID NO: 440. In some additional embodiments, the polypeptide sequence of the engineered glycosyltransferase comprises at least one mutation or mutation set at one or more positions selected from 9, 12, 107, 131, 156, 161, 169, 199, 204, 209, 233, 262, 289, 337, and 417, wherein the positions are numbered with reference to SEQ ID NO: 440. In some additional embodiments, the polypeptide sequence of the engineered glycosyltransferase comprises at least one mutation or mutation set selected from 9L, 12Q, 107C, 131A, 156S, 161E, 169T, 199S, 204M, 209Y, 233K, 262A, 289A, 337N, 337W, and 417V, wherein the positions are numbered with reference to SEQ ID NO: 440. In some additional embodiments, the polypeptide sequence of the engineered glycosyltransferase comprises at least one mutation or mutation set selected from V9L, R12Q, A107C, P131A, C156S, L161E, E169T, A199S, D204M, E209Y, Q233K, S262A, K289A, S337N, S337W, and P417V, wherein the positions are numbered with reference to SEQ ID NO: 440. In some additional embodiments, the polypeptide sequence of the engineered glycosyltransferase comprises at least one mutation or mutation set at one or more positions selected from 146/170/196, 146/170/196/232, 146/170/196/232/451/455, 146/170/232, 146/170/232/423/448/451/455, 146/196/232, 146/196/232/259/448/451, and 146/232/448, wherein the positions are numbered with reference to SEQ ID NO: 440. In some additional embodiments, the polypeptide sequence of the engineered glycosyltransferase comprises at least one mutation or mutation set selected from 146G/170S/196I, 146G/170S/232I, 146G/170S/232I/423K/448H/451E/455M, 146G/170T/196I/232I, 146G/170T/196I/232I/451E/455R, 146G/196I/232I, 146G/196I/232I/259E/448H/451E, and 146G/232I/448H, wherein the positions are numbered with reference to SEQ ID NO: 440. In some additional embodiments, the polypeptide sequence of the engineered glycosyltransferase comprises at least one mutation or mutation set selected from S146G/D170S/W196I, S146G/D170S/V232I, S146G/D170S/V232I/R423K/E448H/Q451E/S455M, S146G/D170T/W196I/V232I, S146G/D170T/W196I/V232I/Q451E/S455R, S146G/W196I/V232I, S146G/W196I/V232I/T259E/E448H/Q451E, and S146G/V232I/E448H, wherein the positions are numbered with reference to SEQ ID NO: 440.

In yet some further embodiments, the polypeptide sequence of the engineered glycosyltransferase comprises at least one mutation or mutation set at one or more positions selected from 9/12/107/161/199/209/337, 9/12/161/169/199/209/337, 9/12/199/204/209/337/455, 9/12/199/209/337/451/455, 9/107/131/204/259/417/451, 9/107/156/161/199/204/417/455, 9/107/161/209/259/289/451/455, 9/131/156/209/289/337, 9/131/204/337/451, 9/156/169/204/337, 9/169/204/289/337/451/455, 9/204, 9/204/259/289, 9/337, 12/14/107/204/289/455, 12/107/131/204/289/337/417/451/455, 12/107/156/209/289/455, 107/161/169/199/204/259/451, 107/199/204/289, 107/199/209/259/451/455, 107/204, 156/169/199/204/209/259/289, 161/204/417, 204/451/455, 289, and 451/455, wherein the positions are numbered with reference to SEQ ID NO: 520. In some additional embodiments, the polypeptide sequence of the engineered glycosyltransferase comprises at least one mutation or mutation set selected from 9L/12Q/107C/161E/199S/209Y/337N, 9L/12Q/161E/169T/199S/209Y/337W, 9L/12Q/199S/204M/209Y/337N/455R, 9L/12Q/199S/209Y/337W/451E/455R, 9L/107C/131A/204M/259E/417V/451E, 9L/107C/156S/161E/199S/204M/417V/455R, 9L/107C/161E/209Y/259E/289A/451E/455R, 9L/131A/156S/209Y/289A/337N, 9L/131A/204M/337N/451E, 9L/156S/169T/204M/337N, 9L/169T/204M/289A/337W/451E/455R, 9L/204M, 9L/204M/259E/289A, 9L/337W, 12Q/14I/107C/204M/289A/455R, 12Q/107C/131A/204M/289A/337W/417V/451E/455R, 12Q/107C/156S/209Y/289A/455R, 107C/161E/169T/199S/204M/259E/451E, 107C/199S/204M/289A, 107C/199S/209Y/259E/451E/455R, 107C/204M, 156S/169T/199S/204M/209Y/259E/289A, 161E/204M/417V, 204M/451E/455R, 289A, and 451E/455R, wherein the positions are numbered with reference to SEQ ID NO: 520. In some additional embodiments, the polypeptide sequence of the engineered glycosyltransferase comprises at least one mutation or mutation set selected from V9L/R12Q/A107C/L161E/A199S/E209Y/S337N, V9L/R12Q/L161E/E169T/A199S/E209Y/S337W, V9L/R12Q/A199S/D204M/E209Y/S337N/S455R, V9L/R12Q/A199S/E209Y/S337W/Q451E/S455R, V9L/A107C/P131A/D204M/T259E/P417V/Q451E, V9L/A107C/C156S/L161E/A199S/D204M/P417V/S455R, V9L/A107C/L161E/E209Y/T259E/K289A/Q451E/S455R, V9L/P131A/C156S/E209Y/K289A/S337N, V9L/P131A/D204M/S337N/Q451E, V9L/C156S/E169T/D204M/S337N, V9L/E169T/D204M/K289A/S337W/Q451E/S455R, V9L/D204M, V9L/D204M/T259E/K289A, V9L/S337W, R12Q/V14I/A107C/D204M/K289A/S455R, R12Q/A107C/P131A/D204M/K289A/S337W/P417V/Q451E/S455R, R12Q/A107C/C156S/E209Y/K289A/S455R, A107C/L161E/E169T/A199S/D204M/ T259E/Q451E, A107C/A199S/D204M/K289A, A107C/A199S/E209Y/T259E/Q451E/S455R, A107C/D204M, C156S/E169T/A199S/D204M/E209Y/T259E/K289A, L161E/D204M/P417V, D204M/Q451E/S455R, K289A, and Q451E/S455R, wherein the positions are numbered with reference to SEQ ID NO: 520. In some further embodiments, the polypeptide sequence of the engineered glycosyltransferase comprises at least one mutation or mutation set at one or more positions selected from 16, 53, 54, 78, 80, 95, 111, 221, 257, 336, 349, 391, 410, 413, 426, and 430, wherein the positions are numbered with reference to SEQ ID NO: 520. In some additional embodiments, the polypeptide sequence of the engineered glycosyltransferase comprises at least one mutation or mutation set selected from 16M, 53Q, 54P, 78V, 80A, 95W, 111C, 111G, 111S, 221A, 257A, 336R, 349V, 391R, 410V, 413L, 426S, and 430Q, wherein the positions are numbered with reference to SEQ ID NO: 520. In some additional embodiments, the polypeptide sequence of the engineered glycosyltransferase comprises at least one mutation or mutation set selected from L16M, K53Q, T54P, L78V, T80A, H95W, T111C, T111G, T111S, F221A, L257A, K336R, I349V, L391R, I410V, V413L, A426S, and K430Q, wherein the positions are numbered with reference to SEQ ID NO: 520. In some additional embodiments, the polypeptide sequence of the engineered glycosyltransferase comprises at least one mutation or mutation set at one or more positions selected from 9/12/199/204/209/337/455, 9/131/156/209/289/337, 9/204, 12/14/107/204/289/455, 107/161/169/199/204/259/451, 107/199/204/289, and 204/451/455, wherein the positions are numbered with reference to SEQ ID NO: 520. In some additional embodiments, the polypeptide sequence of the engineered glycosyltransferase comprises at least one mutation or mutation set selected from 9L/12Q/199S/204M/209Y/337N/455R, 9L/131A/156S/209Y/289A/337N, 9L/204M, 12Q/14I/107C/204M/289A/455R, 107C/161E/169T/199S/204M/259E/451E, 107C/199S/204M/289A, and 204M/451E/455R, wherein the positions are numbered with reference to SEQ ID NO: 520. In some additional embodiments, the polypeptide sequence of the engineered glycosyltransferase comprises at least one mutation or mutation set selected from V9L/R12Q/A199S/D204M/E209Y/S337N/S455R, V9L/P131A/C156S/E209Y/K289A/S337N, V9L/D204M, R12Q/V14I/A107C/D204M/K289A/S455R, A107C/L161E/E169T/A199S/D204M/T259E/Q451E, A107C/A199S/D204M/K289A, and D204M/Q451E/S455R, wherein the positions are numbered with reference to SEQ ID NO: 520. In yet some further embodiments, the polypeptide sequence of the engineered glycosyltransferase comprises at least one mutation or mutation set at one or more positions selected from 16, 16/59/80/413, 16/80, 16/80/111, 16/80/111/257, 16/80/221/257/336/410, 16/80/221/336/410, 16/80/257, 16/111/221, 16/111/221/257/391, 16/221, 16/221/257, 16/221/257/336/391, 16/221/410, 16/257, 16/257/336/413/420, 80/111/221/257/410, 111/221/257/336/391, 111/221/257/391, 221, and 221/257, wherein the positions are numbered with reference to SEQ ID NO: 626. In some additional embodiments, the polypeptide sequence of the engineered glycosyltransferase comprises at least one mutation or mutation set selected from 16M, 16M/59Q/80A/413L, 16M/80A, 16M/80A/111C, 16M/80A/111S/257A, 16M/80A/221A/257A/336R/410V, 16M/80A/221A/336R/410V, 16M/80A/257A, 16M/111C/221A/257A/391R, 16M/111S/221A, 16M/221A, 16M/221A/257A, 16M/221A/257A/336R/391R, 16M/221A/410V, 16M/257A, 16M/257A/336R/413L/420G, 80A/111S/221A/257A/410V, 111S/221A/257A/336R/391R, 111S/221A/

257A/391R, 221A, and 221A/257A, wherein the positions are numbered with reference to SEQ ID NO: 626. In some additional embodiments, the polypeptide sequence of the engineered glycosyltransferase comprises at least one mutation or mutation set selected from L16M, L16M/H59Q/T80A/V413L, L16M/T80A, L16M/T80A/T111C, L16M/T80A/T111S/L257A, L16M/T80A/F221A/L257A/K336R/I410V, L16M/T80A/F221A/K336R/I410V, L16M/T80A/L257A, L16M/T111C/F221A/L257A/L391R, L16M/T111S/F221A, L16M/F221A, L16M/F221A/L257A, L16M/F221A/L257A/K336R/L391R, L16M/F221A/I410y, L16M/L257A, L16M/L257A/K336R/V413L/E420G, T80A/T111S/F221A/L257A/I410V, T111S/F221A/L257A/K336R/L391R, T111S/F221A/L257A/L391R, F221A, and F221A/L257A, wherein the positions are numbered with reference to SEQ ID NO: 626. In some further embodiments, the polypeptide sequence of the engineered glycosyltransferase comprises at least one mutation or mutation set at one or more positions selected from 5, 7, 14, 65, 91, 99, 102, 118, 138, 194, 254, 286, 416, 418, and 420, wherein the positions are numbered with reference to SEQ ID NO: 626. In some additional embodiments, the polypeptide sequence of the engineered glycosyltransferase comprises at least one mutation or mutation set selected from 5L, 5M, 5N, 5Q, 7L, 14L, 65V, 91V, 99L, 99S, 102R, 118S, 118V, 138I, 194P, 254G, 254T, 254V, 286L, 416E, 418D, and 420A, wherein the positions are numbered with reference to SEQ ID NO: 626. In some additional embodiments, the polypeptide sequence of the engineered glycosyltransferase comprises at least one mutation or mutation set selected from S5L, S5M, S5N, S5Q, T7L, V14L, I65V, Q91V, E99L, E99S, K102R, A118S, A118V, L138I, S194P, S254G, S254T, S254V, V286L, D416E, E418D, and E420A, wherein the positions are numbered with reference to SEQ ID NO: 626. In yet some further embodiments, the polypeptide sequence of the engineered glycosyltransferase comprises at least one mutation or mutation set at one or more positions selected from 16/80/221/257/336/410, 16/111/221, 16/221/257, 16/221/410, 16/257, 80/111/221/257/410, and 221, wherein the positions are numbered with reference to SEQ ID NO: 626. In some additional embodiments, the polypeptide sequence of the engineered glycosyltransferase comprises at least one mutation or mutation set selected from 16M/80A/221A/257A/336R/410V, 16M/111S/221A, 16M/221A/257A, 16M/221A/410V, 16M/257A, 80A/111S/221A/257A/410V, and 221A, wherein the positions are numbered with reference to SEQ ID NO: 626. In some additional embodiments, the polypeptide sequence of the engineered glycosyltransferase comprises at least one mutation or mutation set selected from L16M/T80A/F221A/L257A/K336R/I410V, L16M/T111S/F221A, L16M/F221A/L257A, L16M/F221A/I410V, L16M/L257A, T80A/T111S/F221A/L257A/I410V, and F221A, wherein the positions are numbered with reference to SEQ ID NO: 626.

In yet some further embodiments, the polypeptide sequence of the engineered glycosyltransferase comprises at least one mutation or mutation set at one or more positions selected from 5, 5/14/99, 5/14/416, 5/91, 5/91/102/118, 5/91/102/254/418, 5/91/106/254/286, 5/91/118/194/254/286, 5/91/118/194/254/418, 5/91/118/194/418, 5/91/118/254/286/418, 5/91/118/286, 5/91/194/254, 5/91/194/418, 5/91/254, 5/91/254/286, 5/102/418, 5/118/194/286/418, 5/118/254, 5/118/286, 5/194, 5/254/286, 5/418, 7/14, 7/14/65/99, 7/14/99/416, 14, 14/65/99/416, 14/99, 14/99/254, 14/99/254/416, 14/99/254/416/455, 14/99/416, 14/167, 14/254, 14/455, 91, 91/102/194, 91/118, 91/118/194, 91/118/194/286, 91/118/194/418, 91/118/286, 91/194/254/286, 91/286, and 118/286/418, wherein the positions are numbered with reference to SEQ ID NO: 678.

In some additional embodiments, the polypeptide sequence of the engineered glycosyltransferase comprises at least one mutation or mutation set selected from 5L/14L/99L, 5L/14L/416E, 5N, 5N/91V, 5N/91V/102R/118V, 5N/91V/102R/254T/418D, 5N/91V/106I/254T/286L, 5N/91V/118S/194P/254T/418D, 5N/91V/118S/254T/286L/418D, 5N/91V/118S/286L, 5N/91V/118V/194P/254T/286L, 5N/91V/118V/194P/418D, 5N/91V/194P/254T, 5N/91V/194P/418D, 5N/91V/254T, 5N/91V/254T/286L, 5N/102R/418D, 5N/118S/194P/286L/418D, 5N/118S/286L, 5N/118V/254T, 5N/194P, 5N/254T/286L, 5N/418D, 7L/14L, 7L/14L/65V/99L, 7L/14L/99S/416E, 14L, 14L/65V/99L/416E, 14L/99L, 14L/99L/254G, 14L/99L/254G/416E, 14L/99L/254G/416E/455R, 14L/99L/416E, 14L/99S/416E, 14L/167E, 14L/254G, 14L/455R, 91V, 91V/102R/194P, 91V/118V, 91V/118V/194P, 91V/118V/194P/286L, 91V/118V/194P/418D, 91V/118V/286L, 91V/194P/254T/286L, 91V/286L, and 118V/286L/418D, wherein the positions are numbered with reference to SEQ ID NO: 678. In some additional embodiments, the polypeptide sequence of the engineered glycosyltransferase comprises at least one mutation or mutation set selected from S5L/V14L/E99L, S5L/V14L/D416E, S5N, S5N/Q91V, S5N/Q91V/K102R/A118V, S5N/Q91V/K102R/S254T/E418D, S5N/Q91V/S106I/S254T/V286L, S5N/Q91V/A118S/S194P/S254T/E418D, S5N/Q91V/A118S/S254T/V286L/E418D, S5N/Q91V/A118S/V286L, S5N/Q91V/A118V/S194P/S254T/V286L, S5N/Q91V/A118V/S194P/E418D, S5N/Q91V/S194P/S254T, S5N/Q91V/S194P/E418D, S5N/Q91V/S254T, S5N/Q91V/S254T/V286L, S5N/K102R/E418D, S5N/A118S/S194P/V286L/E418D, S5N/A118S/V286L, S5N/A118V/S254T, S5N/S194P, S5N/S254T/V286L, S5N/E418D, T7L/V14L, T7L/V14L/I65V/E99L, T7L/V14L/E99S/D416E, V14L, V14L/I65V/E99L/D416E, V14L/E99L, V14L/E99L/S254G, V14L/E99L/S254G/D416E, V14L/E99L/S254G/D416E/S455R, V14L/E99L/D416E, V14L/E99S/D416E, V14L/D167E, V14L/S254G, V14L/S455R, Q91V, Q91V/K102R/S194P, Q91V/A118V, Q91V/A118V/S194P, Q91V/A118V/S194P/V286L, Q91V/A118V/S194P/E418D, Q91V/A118V/V286L, Q91V/S194P/S254T/V286L, Q91V/V286L, and A118V/V286L/E418D, wherein the positions are numbered with reference to SEQ ID NO: 678. In some additional embodiments, the polypeptide sequence of the engineered glycosyltransferase comprises at least one mutation or mutation set at one or more positions selected from 5/91/106/254/286, 5/91/118/286, 5/91/254/286, 14, 14/65/99/416, 14/99, and 14/99/254, wherein the positions are numbered with reference to SEQ ID NO: 678. In some additional embodiments, the polypeptide sequence of the engineered glycosyltransferase comprises at least one mutation or mutation set selected from 5N/91V/106I/254T/286L, 5N/91V/118S/286L, 5N/91V/254T/286L, 14L, 14L/65V/99L/416E, 14L/99L, and 14L/99L/254G, wherein the positions are numbered with reference to SEQ ID NO: 678. In some additional embodiments, the polypeptide sequence of the engineered glycosyltransferase comprises at least one mutation or mutation set selected from S5N/Q91V/S106I/S254T/V286L, S5N/Q91V/A118S/V286L, S5N/Q91V/S254T/V286L, V14L, V14L/I65V/E99L/D416E, V14L/E99L, and V14L/E99L/S254G, wherein the positions are numbered with reference to SEQ ID NO: 678.

The present invention also provides engineered glycosyltransferases comprising polypeptide sequences that have at least 90%, 91%, 92%, 93%, 94%, 95%, 96%, 97%, 98%, 99%, or more sequence identity to SEQ ID NO: 12. In some embodiments, the polypeptide sequence of the engineered glycosyltransferase comprises at least one mutation or mutation set at one or more positions selected from 16, 16/127/169, 16/134, 16/143/423, 16/169, 16/169/398/399, 16/169/423, 16/398, 16/398/399, 16/398/427, 16/423, 16/423/427, 134, 143, 399/423, and 423/427, wherein the positions are numbered with reference to SEQ ID NO: 24. In some additional embodiments, the polypeptide sequence of the engineered glycosyltransferase comprises at least one mutation or mutation set selected from 16T, 16T/127V/169E, 16T/134S, 16T/143G/423L, 16T/169E, 16T/169E/398M/399K, 16T/169E/423L, 16T/398M, 16T/398M/399K, 16T/398M/427S, 16T/423L, 16T/423L/427S, 134S, 143G, 399K/423L, and 423L/427S, wherein the positions are numbered with reference to SEQ ID NO: 24. In some additional embodiments, the polypeptide sequence of the engineered glycosyltransferase comprises at least one mutation or mutation set selected from L16T, L16T/Q127V/P169E, L16T/A134S, L16T/P143G/R423L, L16T/P169E, L16T/P169E/A398M/Q399K, L16T/P169E/R423L, L16T/A398M, L16T/A398M/Q399K, L16T/A398M/R427S, L16T/R423L, L16T/R423L/R427S, A134S, P143G, Q399K/R423L, and R423L/R427S, wherein the positions are numbered with reference to SEQ ID NO: 24. In some additional embodiments, the polypeptide sequence of the engineered glycosyltransferase comprises at least one mutation or mutation set at one or more positions selected from 3, 8, 11, 41, 44, 56, 60, 122, 135, 137, 138, 139, 158, 164, 176, 221, 232, 233, 235, 248, 249, 281, 284, 285, 301, 322, 372, 392, 400, 421, 426, 427, 433, 440, 443, and 446, wherein the positions are numbered with reference to SEQ ID NO: 24. In some additional embodiments, the polypeptide sequence of the engineered glycosyltransferase comprises at least one mutation or mutation set selected from 3I, 3V, 8R, 11L, 11P, 41M, 44E, 56A, 60T, 122C, 135V, 137T, 138K, 138R, 139T, 158H, 158V, 164A, 164E, 164N, 164Q, 164S, 176S, 221D, 232A, 233S, 233T, 235L, 235M, 248M, 249R, 281S, 284V, 285A, 301G, 322R, 372S, 392V, 400C, 421A, 421G, 426S, 427A, 427W, 433G, 433T, 440L, 440M, 443G, 443H, and 446L, wherein the positions are numbered with reference to SEQ ID NO: 24. In some additional embodiments, the polypeptide sequence of the engineered glycosyltransferase comprises at least one mutation or mutation set selected from H3I, H3V, V8R, Q11L, Q11P, F41M, Y44E, K56A, P60T, L122C, L135V, Q137T, G138K, G138R, I139T, F158H, F158V, H164A, H164E, H164N, H164Q, H164S, R176S, E221D, P232A, P233S, P233T, Q235L, Q235M, I248M, D249R, G281S, L284V, S285A, Q301G, L322R, A372S, I392V, V400C, S421A, S421G, A426S, R427A, R427W, N433G, N433T, I440L, I440M, C443G, C443H, and R446L, wherein the positions are numbered with reference to SEQ ID NO: 24. In some further embodiments, the polypeptide sequence of the engineered glycosyltransferase comprises at least one mutation or mutation set at one or more positions selected from 16, 16/127/169, and 16/169, wherein the positions are numbered with reference to SEQ ID NO: 24. In some additional embodiments, the polypeptide sequence of the engineered glycosyltransferase comprises at least one mutation or mutation set selected from 16T, 16T/127V/169E, and 16T/169E, wherein the positions are numbered with reference to SEQ ID NO: 24. In some additional embodiments, the polypeptide sequence of the engineered glycosyltransferase comprises at least one mutation or mutation set selected from L16T, L16T/Q127V/P169E, and L16T/P169E, wherein the positions are numbered with reference to SEQ ID NO: 24.

In some further embodiments, the polypeptide sequence of the engineered glycosyltransferase comprises at least one mutation or mutation set at one or more positions selected from 3/22/198/421, 3/22/421, 3/201/248/322, 3/201/248/322/392, 13/233/331/440, 13/440/443, 22/32/56/60/198/248/322/392/421, 22/56, 22/56/137/198/201/248/322/392, 22/56/137/198/248/392/421, 22/56/137/322, 22/56/137/322/392/423, 22/56/198/202/248, 22/56/198/248/322/392/421, 22/56/198/248/421/423, 22/56/421/423, 22/60/392/421, 22/137, 22/137/198/202/248, 22/198/202/248/392, 22/248/392, 22/392, 22/421, 22/421/423, 22/423, 44/164/233, 44/164/233/329/331, 44/331, 125, 125/233/443/446, 164/221/233/331/440/446, 164/233/331/440, 164/233/446, 164/331, 164/440, 164/443, 198/202/392, 221/329/331, 233, 233/446, 329, 421/423, and 443/446, wherein the positions are numbered with reference to SEQ ID NO: 858. In some additional embodiments, the polypeptide sequence of the engineered glycosyltransferase comprises at least one mutation or mutation set selected from 3I/22 G/198Q/421G, 3I/22G/421G, 3I/201A/248M/322R, 3I/201A/248M/322R/392V, 13Q/233S/331V/440M, 13Q/440M/443G, 22G/32L/56A/60T/198Q/248M/322R/392V/421G, 22G/56A, 22G/56A/137T/198Q/201A/248M/322R/392V, 22G/56A/137T/198Q/248M/392V/421G, 22G/56A/137T/322R, 22G/56A/137T/322R/392V/423L, 22G/56A/198Q/202Y/248M, 22G/56A/198Q/248M/322R/392V/421G, 22G/56A/198Q/248M/421G/423L, 22G/56A/421G/423L, 22G/60T/392V/421G, 22G/137T, 22G/137T/198Q/202Y/248M, 22G/198Q/202Y/248M/392V, 22G/248M/392V, 22G/392V, 22G/421G, 22G/421G/423L, 22G/423L, 44E/164A/233S, 44E/164E/233S, 44E/164E/233S/329L/331V, 44E/331V, 125L, 125L/233S/443G/446L, 164A/233S/446L, 164A/331V, 164A/440M, 164A/443G, 164E/221D/233S/331V/440M/446L, 164E/233S/331V/440M, 198Q/202Y/392V, 221D/329L/331V, 233S, 233S/446L, 329L, 421G/423L, and 443G/446L, wherein the positions are numbered with reference to SEQ ID NO: 858. In some additional embodiments, the polypeptide sequence of the engineered glycosyltransferase comprises at least one mutation or mutation set selected from H3I/A22G/G198Q/S421G, H3I/A22G/S421G, H3I/G201A/I248M/L322R, H3I/G201A/I248M/L322R/I392V, L13Q/P233S/I331V/I440M, L13Q/I440M/C443G, A22G/I32L/K56A/P60T/G198Q/I248M/L322R/I392V/S421G, A22G/K56A, A22G/K56A/Q137T/G198Q/G201A/I248M/L322R/I392V, A22G/K56A/Q137T/G198Q/I248M/I392V/S421G, A22G/K56A/Q137T/L322R, A22G/K56A/Q137T/L322R/I392V/R423L, A22G/K56A/G198Q/I202Y/I248M, A22G/K56A/G198Q/I248M/L322R/I392V/S421G, A22G/K56A/G198Q/I248M/S421G/R423L, A22G/K56A/S421G/R423L, A22G/P60T/I392V/S421G, A22G/Q137T, A22G/Q137T/G198Q/I202Y/I248M, A22G/G198Q/I202Y/I248M/I392V, A22G/I248M/I392V, A22G/I392V, A22G/S421G, A22G/S421G/R423L, A22G/R423L, Y44E/H164A/P233S, Y44E/H164E/P233S, Y44E/H164E/P233S/A329L/I331V, Y44E/I331V, F125L, F125L/P233S/C443G/R446L, H164A/P233S/R446L, H164A/I331V, H164A/I440M, H164A/C443G, H164E/E221D/P233S/I331V/I440M/R446L, H164E/P233S/I331V/I440M, G198Q/I202Y/I392V, E221D/A329L/I331V, P233S, P233S/R446L, A329L, S421G/R423L, and C443G/R446L, wherein the positions are numbered with reference to SEQ ID NO: 858. In some additional embodiments, the polypeptide sequence of the engineered glycosyltransferase comprises at least one mutation or mutation set at one or more positions selected from 3/22/198/421, 13/440/443, 22/56/198/202/248, 22/137, 22/198/202/248/392, 164/221/233/331/440/446, 164/233/331/440, and 233/446, wherein the positions are numbered with reference to SEQ ID NO: 858. In some additional embodiments, the polypeptide sequence of the engineered glycosyltransferase comprises at least one mutation or mutation set selected from 3I/22G/198Q/421G, 13Q/440M/443G, 22G/56A/198Q/202Y/248M, 22G/137T, 22G/198Q/202Y/248M/392V, 164E/221D/233S/331V/440M/446L, 164E/233S/331V/440M, and 233S/446L, wherein the positions are numbered with reference to SEQ ID NO: 858. In some additional embodiments, the polypeptide sequence of the engineered glycosyltransferase comprises at least one mutation or mutation set selected from H3I/A22G/G198Q/S421G, L13Q/I440M/C443G, A22G/K56A/G198Q/I202Y/I248M, A22G/Q137T, A22G/G198Q/I202Y/I248M/I392V, H164E/E221D/P233S/I331V/I440M/R446L, H164E/P233S/I331V/I440M, and P233S/R446L, wherein the positions are numbered with reference to SEQ ID NO: 858.

In some further embodiments, the polypeptide sequence of the engineered glycosyltransferase comprises at least one mutation or mutation set at one or more positions selected from 83/202/233, 164, 164/202, 164/202/233/331, 164/202/248/272, 164/202/331, 164/202/331/423, 164/423, 202/233, 202/233/248, 202/233/248/423, 202/248, 202/331, 202/421/423, 202/423, 202/446, 233, 248, and 423, wherein the positions are numbered with reference to SEQ ID NO: 994. In some additional embodiments, the polypeptide sequence of the engineered glycosyltransferase comprises at least one mutation or mutation set selected from 83Y/202I/233S, 164E, 164E/202I, 164E/202I/233S/331V, 164E/202I/248I/272C, 164E/202I/331V, 164E/202I/331V/423L, 164E/423L, 202I/233S, 202I/233S/248I, 202I/233S/248I/423L, 202I/248I, 202I/331V, 202I/421G/423L, 202I/423L, 202I/446L, 233S, 248I, and 423L, wherein the positions are numbered with reference to SEQ ID NO: 994. In some additional embodiments, the polypeptide sequence of the engineered glycosyltransferase comprises at least one mutation or mutation set selected from H83Y/Y202I/P233S, H164E, H164E/Y202I, H164E/Y202I/P233S/I331V, H164E/Y202I/M248I/R272C, H164E/Y202I/331V, H164E/Y202I/331V/R423L, H164E/R423L, Y202I/P233S, Y202I/P233S/M248I, Y202I/P233S/M248I/R423L, Y202I/M248I, Y202I/331V, Y202I/S421G/R423L, Y202I/R423L, Y202I/R446L, P233S, M248I, and R423L, wherein the positions are numbered with reference to SEQ ID NO: 994. In some embodiments, the polypeptide sequence of the engineered glycosyltransferase comprises at least one mutation or mutation set at one or more positions selected from 7, 9, 10, 54, 73, 84, 106, 115, 116, 132, 165, 286, 309, 389, 406, 422, and 438, wherein the positions are numbered with reference to SEQ ID NO: 994. In some additional embodiments, the polypeptide sequence of the engineered glycosyltransferase comprises at least one mutation or mutation set selected from 7T, 9L, 10P, 54L, 54M, 73R, 73S, 84L, 106S, 115A, 116I, 132R, 165P, 286G, 309E, 389E, 406H, 406M, 406Q, 422A, 422T, 422V, 438A, and 438T, wherein the positions are numbered with reference to SEQ ID NO: 994. In some additional embodiments, the polypeptide sequence of the engineered glycosyltransferase comprises at least one mutation or mutation set selected from G7T, S9L, D10P, S54L, S54M, A73R, A73S, Y84L, A106S, N115A, L116I, K132R, E165P, N286G, K309E, D389E, S406H, S406M, S406Q, K422A, K422T, K422V, E438A, and E438T, wherein the positions are numbered with reference to SEQ ID NO: 994. In some further embodiments, the polypeptide sequence of the engineered glycosyltransferase comprises at least one mutation or mutation set at one or more positions selected from 83/202/233, 164, 164/202, 164/423, 202/233/248, and 233, wherein the positions are numbered with reference to SEQ ID NO: 994. In some additional embodiments, the polypeptide sequence of the engineered glycosyltransferase comprises at least one mutation or mutation set selected from 83Y/202I/233S, 164E, 164E/202I, 164E/423L, 202I/233S/248I, and 233S, wherein the positions are numbered with reference to SEQ ID NO: 994. In some additional embodiments, the polypeptide sequence of the engineered glycosyltransferase comprises at least one mutation or mutation set selected from H83Y/Y202I/P233S, H164E, H164E/Y202I, H164E/R423L, Y202I/P233S/M248I, and P233S, wherein the positions are numbered with reference to SEQ ID NO: 994.

In yet some further embodiments, the polypeptide sequence of the engineered glycosyltransferase comprises at least one mutation or mutation set at one or more positions selected from 7/9/73/165/286, 7/9/165/286, 7/9/422, 7/116/165/286, 7/165, 9/73/116/165/286/422, 9/286/389, 54, 54/84, 54/406, 73, 73/116/165/286/389, 73/116/286, 73/116/286/422, 73/165/286, 73/286/389, 73/286/422, 73/422, 84, 115, 116, 116/165, 116/165/286/422, 116/389, 165, 165/286, 165/389, 165/389/422, 286, 286/422, 389/422, and 422, wherein the positions are numbered with reference to SEQ ID NO: 1080. In some additional embodiments, the polypeptide sequence of the engineered glycosyltransferase comprises at least one mutation or mutation set selected from 7T/9L/73R/165P/286G, 7T/9L/165P/286G, 7T/9L/422A, 7T/116I/165P/286G, 7T/165P, 9L/73R/116I/165P/286G/422A, 9L/286G/389E, 54L/84L, 54M, 54M/406M, 73R, 73R/116I/165P/286G/389E, 73R/116I/286G, 73R/116I/286G/422A, 73R/165P/286G, 73R/286G/389E, 73R/286G/422A, 73R/286G/422T, 73R/422T, 84L, 115A, 116I, 116I/165P, 116I/165P/286G/422A, 116I/389E, 165P, 165P/286G, 165P/389E, 165P/389E/422T, 286G, 286G/422A, 389E/422A, and 422T, wherein the positions are numbered with reference to SEQ ID NO: 1080. In some additional embodiments, the polypeptide sequence of the engineered glycosyltransferase comprises at least one mutation or mutation set selected from G7T/S9L/A73R/E165P/N286G, G7T/S9L/E165P/N286G, G7T/S9L/K422A, G7T/L116I/E165P/N286G, G7T/E165P, S9L/A73R/L116I/E165P/N286G/K422A, S9L/N286G/D389E, S54L/Y84L, S54M, S54M/S406M, A73R, A73R/L116I/E165P/N286G/D389E, A73R/L116I/N286G, A73R/L116I/N286G/K422A, A73R/E165P/N286G, A73R/N286G/D389E, A73R/N286G/K422A, A73R/N286G/K422T, A73R/K422T, Y84L, N115A, L116I, L116I/E165P, L116I/E165P/N286G/K422A, L116I/D389E, E165P, E165P/N286G, E165P/D389E, E165P/D389E/K422T, N286G, N286G/K422A, D389E/K422A, and K422T, wherein the positions are numbered with reference to SEQ ID NO: 1080. In some further embodiments, the polypeptide sequence of the engineered glycosyltransferase comprises at least one mutation or mutation set at one or more positions selected from 185/190, 219, 220, 255, 257, 302, 385, 395, 395/437, 399, 401, 409, 412, 416, 434, 441, 445, 447, and 449, wherein the positions are numbered with reference to SEQ ID NO: 1080. In some additional embodiments, the polypeptide sequence of the engineered glycosyltransferase comprises at least one mutation or mutation set selected from 185L/190P, 219L, 220A, 255R, 257H, 302A, 302H, 302L, 302R, 302T, 385M, 385P, 385S, 395A, 395D, 395H, 395N, 395S/437L, 399R, 401V, 409L, 412K, 416N, 434I, 441A, 441K, 441L, 441R, 441S, 445K, 445R, 447A, 447R, 447S, 447V, 449A, 449H, and 449T, wherein the positions are numbered with reference to SEQ ID NO: 1080. In some additional embodiments, the polypeptide sequence of the engineered glycosyltransferase comprises at least one mutation or mutation set selected from F185L/

T190P, C219L, T220A, P255R, N257H, N302A, N302H, N302L, N302R, N302T, V385M, V385P, V385S, G395A, G395D, G395H, G395N, G395S/E437L, Q399R, L401V, T409L, I412K, K416N, A434I, Q441A, Q441K, Q441L, Q441R, Q441S, N445K, N445R, N447A, N447R, N447S, N447V, Y449A, Y449H, and Y449T, wherein the positions are numbered with reference to SEQ ID NO: 1080. In some further embodiments, the polypeptide sequence of the engineered glycosyltransferase comprises at least one mutation or mutation set at one or more positions selected from 9/73/116/165/286/422, 54, 54/84, 54/406, 73/116/286/422, 116/165/286/422, and 286/422, wherein the positions are numbered with reference to SEQ ID NO: 1080. In some additional embodiments, the polypeptide sequence of the engineered glycosyltransferase comprises at least one mutation or mutation set selected from 9L/73R/116I/165P/286G/422A, 54L/84L, 54M, 54M/406M, 73R/116I/286G/422A, 116I/165P/286G/422A, and 286G/422A, wherein the positions are numbered with reference to SEQ ID NO: 1080. In some additional embodiments, the polypeptide sequence of the engineered glycosyltransferase comprises at least one mutation or mutation set selected from S9L/A73R/L116I/E165P/N286G/K422A, S54L/Y84L, S54M, S54M/S406M, A73R/L116I/N286G/K422A, L116I/E165P/N286G/K422A, and N286G/K422A, wherein the positions are numbered with reference to SEQ ID NO: 1080.

In yet some further embodiments, the polypeptide sequence of the engineered glycosyltransferase comprises at least one mutation or mutation set at one or more positions selected from 54, 54/185/190, 54/185/190/219/257/302/385/389/395/445/447/449, 54/185/190/219/385, 54/185/190/219/385/389/395/399/441/445/447/449, 54/185/190/219/385/395/399/441/445/447/449, 54/185/190/219/385/445/447, 54/185/190/219/389/395/399/441/445/447/449, 54/185/190/302, 54/185/190/302/395/399, 54/185/190/385/447/449, 54/185/190/389/395, 54/185/190/389/441/445/447/449, 54/185/190/389/445, 54/185/190/395/399/441/445/447/449, 54/185/219/389, 54/185/257/389/441/445/447/449, 54/185/302/385/399/445/447, 54/185/385/389/395/441/445/449, 54/185/385/395/399/445/447/449, 54/185/389/395/445/447, 54/190/219/257/302, 54/190/219/257/395/445/447/449, 54/190/257, 54/190/257/302/399, 54/190/257/309/385/389/395/399/445, 54/190/257/385/389, 54/190/257/395/445/449, 54/190/302/389, 54/190/302/389/395/399/445/447, 54/190/385/389/395/441/445, 54/190/385/395, 54/190/385/445/447/449, 54/190/395, 54/190/395/445/447, 54/219/302/395/441/445/447, 54/219/385/389/395/441/445/447, 54/257, 54/257/385/449, 54/257/389, 54/257/399, 54/257/441/447, 54/257/441/449, 54/302/385/399/441/445/447, 54/302/385/399/441/445/449, 54/385, 54/385/389/441/445/447/449, 54/389/395/399/447/449, 185/190/219/257/389/395/445/447, 185/190/257/302/395/441/445/447, 185/190/257/385/389/399, 185/190/257/385/399/445/447, 185/190/257/389/395, 185/190/257/389/395/399/441/447/449, 185/190/385/389/441/445/447, 185/190/389/447/449, 185/190/395/399, 185/219/257/399/445/447, 185/257/385/395/399/445/447, 185/302/395/399/441/445/447/449, 185/395/399/441/445/447, 190/219/257/385/389/441/445/447/449, 190/219/302/385/399/445, 190/257/302/385/399, 190/257/385/389/399, 190/257/385/389/445/447, 190/257/385/395, 190/257/385/441/445/447/449, 190/257/385/395/441/445/447, 190/257/389/447/449, 190/302/385/389/395/399/441/445/447, 190/389, 219/257/385/389/395/441/447/449, 219/257/395, 219/385/389/399/445/449, 219/395, 257/385/389/399, 257/389/395/399/445/447, 257/389/395/399/445/449, 257/389/399, 302/389/395/445, 385/389, 385/395, 389/395/445/447, 395/399, and 399, wherein the positions are numbered with reference to SEQ ID NO: 1216.

In some additional embodiments, the polypeptide sequence of the engineered glycosyltransferase comprises at least one mutation or mutation set selected from 54M, 54M/185L/190P, 54M/185L/190P/219L/257H/302R/385P/389E/395H/445K/447A/449H, 54M/185L/190P/219L/385P/445R/447A, 54M/185L/190P/219L/385S, 54M/185L/190P/219L/385S/389E/395D/399R/441R/445R/447A/449H, 54M/185L/190P/219L/385S/395A/399R/441R/445K/447A/449H, 54M/185L/190P/219L/389E/395H/399R/441S/445K/447A/449H, 54M/185L/190P/302H, 54M/185L/190P/302R/395H/399R, 54M/185L/190P/385P/447A/449H, 54M/185L/190P/389E/395H, 54M/185L/190P/389E/441R/445R/447A/449H, 54M/185L/190P/389E/445K, 54M/185L/190P/395D/399R/441R/445K/447A/449H, 54M/185L/219L/389E, 54M/185L/257H/389E/441S/445R/447A/449H, 54M/185L/302H/385S/399R/445R/447A, 54M/185L/385S/389E/395D/441R/445K/449H, 54M/185L/385S/395D/399R/445R/447A/449H, 54M/185L/389E/395D/445K/447A, 54M/190P/219L/257H/302H, 54M/190P/219L/257H/395H/445R/447A/449H, 54M/190P/257H, 54M/190P/257H/302H/399R, 54M/190P/257H/309N/385S/389E/395D/399R/445K, 54M/190P/257H/385S/389E, 54M/190P/257H/395D/445K/449H, 54M/190P/302H/389E/395D/399R/445K/447S, 54M/190P/302R/389E, 54M/190P/385P/395D, 54M/190P/385P/445R/447A/449H, 54M/190P/385S/389E/395H/441S/445R, 54M/190P/395A, 54M/190P/395H/445K/447A, 54M/219L/302R/395H/441S/445R/447A, 54M/219L/385P/389E/395D/441R/445K/447A, 54M/257H, 54M/257H/385S/449H, 54M/257H/389E, 54M/257H/399R, 54M/257H/441R/447A, 54M/257H/441R/449H, 54M/302H/385P/399R/441S/445K/447S, 54M/302H/385S/399R/441S/445R/449H, 54M/385P, 54M/385P/389E/441R/445K/447A/449H, 54M/389E/395D/399R/447A/449H, 185L/190P/219L/257H/389E/395A/445K/447A, 185L/190P/257H/302R/395D/441S/445R/447S, 185L/190P/257H/385P/389E/399R, 185L/190P/257H/385P/399R/445R/447A, 185L/190P/257H/389E/395A, 185L/190P/257H/389E/395H/399R/441S/447S/449H, 185L/190P/385S/389E/441R/445K/447S, 185L/190P/389E/447S/449H, 185L/190P/395D/399R, 185L/190P/395H/399R, 185L/219L/257H/399R/445R/447A, 185L/257H/385S/395A/399R/445R/447A, 185L/302R/395H/399R/441R/445K/447S/449H, 185L/395D/399R/441R/445R/447A, 190P/219L/257H/385S/389E/441S/445R/447A/449H, 190P/219L/302H/385P/399R/445R, 190P/257H/302H/385P/399R, 190P/257H/385P/389E/399R, 190P/257H/385S/389E/445K/447A, 190P/257H/385S/395D, 190P/257H/385S/441S/445R/447S/449H, 190P/257H/389E/395H/441R/445R/447A, 190P/257H/399R/447A/449H, 190P/302H/385P/389E/395D/399R/441S/445K/447S, 190P/389E, 219L/257H/385S/389E/395D/441R/447A/449H, 219L/257H/395H, 219L/385S/389E/399R/445R/449H, 219L/395H, 257H/385P/389E/399R, 257H/389E/395D/399R/445K/447A, 257H/389E/395D/399R/445K/449H, 257H/389E/399R, 302H/389E/395H/445R, 385S/389E, 385S/395D, 389E/395D/445R/447S, 395D/399R, and 399R, wherein the positions are numbered with reference to SEQ ID NO: 1216.

In some additional embodiments, the polypeptide sequence of the engineered glycosyltransferase comprises at least one mutation or mutation set selected from S54M, S54M/F185L/T190P, S54M/F185L/T190P/C219L/N257H/N302R/V385P/D389E/G395H/N445K/N447A/Y449H, S54M/F185L/T190P/C219L/V385P/N445R/N447A, S54M/F185L/T190P/C219L/V385S, S54M/F185L/T190P/C219L/V385S/D389E/Q399R/Q441R/N445R/N447A/Y449H, S54M/F185L/T190P/C219L/V385S/G395A/Q399R/Q441R/N445K/N447A/Y449H, S54M/F185L/T190P/C219L/D389E/G395H/Q399R/Q441S/N445K/N447A/Y449H, S54M/F185L/T190P/N302H, S54M/F185L/T190P/N302R/G395H/Q399R, S54M/F185L/T190P/V385P/N447A/Y449H, S54M/F185L/T190P/D389E/G395H, S54M/F185L/T190P/D389E/Q441R/N445R/N447A/Y449H, S54M/F185L/T190P/D389E/N445K, S54M/F185L/T190P/G395D/Q399R/Q441R/N445K/N447A/Y449H, S54M/F185L/C219L/D389E, S54M/F185L/N257H/D389E/Q441S/N445R/N447A/Y449H, S54M/F185L/N302H/V385S/Q399R/N445R/N447A, S54M/F185L/V385S/D389E/G395D/Q441R/N445K/Y449H, S54M/F185L/V385S/G395D/Q399R/N445R/N447A/Y449H, S54M/F185L/D389E/G395D/N445K/N447A, S54M/T190P/C219L/N257H/N302H, S54M/T190P/C219L/N257H/G395H/N445R/N447A/Y449H, S54M/T190P/N257H, S54M/T190P/N257H/N302H/Q399R, S54M/T190P/N257H/K309N/V385S/D389E/G395D/Q399R/N445K, S54M/T190P/N257H/V385S/D389E, S54M/T190P/N257H/G395D/N445K/Y449H, S54M/T190P/N302H/D389E/G395D/Q399R/N445K/N447S, S54M/T190P/N302R/D389E, S54M/T190P/V385P/G395D, S54M/T190P/V385P/N445R/N447A/Y449H, S54M/T190P/V385S/D389E/G395H/Q441S/N445R, S54M/T190P/G395A, S54M/T190P/G395H/N445K/N447A, S54M/C219L/N302R/G395H/Q441S/N445R/N447A, S54M/C219L/V385P/D389E/G395D/Q441R/N445K/N447A, S54M/N257H, S54M/N257H/V385S/Y449H, S54M/N257H/D389E, S54M/N257H/Q399R, S54M/N257H/Q441R/N447A, S54M/N257H/Q441R/Y449H, S54M/N302H/V385P/Q399R/Q441S/N445K/N447S, S54M/N302H/V385S/Q399R/Q441S/N445R/Y449H, S54M/V385P, S54M/V385P/D389E/Q441R/N445K/N447A/Y449H, S54M/D389E/G395D/Q399R/N447A/Y449H, F185L/T190P/C219L/N257H/D389E/G395A/N445K/N447A, F185L/T190P/N257H/N302R/G395D/Q441S/N445R/N447S, F185L/T190P/N257H/V385P/D389E/Q399R, F185L/T190P/N257H/V385P/Q399R/N445R/N447A, F185L/T190P/N257H/D389E/G395A, F185L/T190P/N257H/D389E/G395H/Q399R/Q441S/N447S/Y449H, F185L/T190P/V385S/D389E/Q441R/N445K/N447S, F185L/T190P/D389E/N447S/Y449H, F185L/T190P/G395D/Q399R, F185L/T190P/G395H/Q399R, F185L/C219L/N257H/Q399R/N445R/N447A, F185L/N257H/V385S/G395A/Q399R/N445R/N447A, F185L/N302R/G395H/Q399R/Q441R/N445K/N447S/Y449H, F185L/G395D/Q399R/Q441R/N445R/N447A, T190P/C219L/N257H/V385S/D389E/Q441S/N445R/N447A/Y449H, T190P/C219L/N302H/V385P/Q399R/N445R, T190P/N257H/N302H/V385P/Q399R, T190P/N257H/V385P/D389E/Q399R, T190P/N257H/V385S/D389E/N445K/N447A, T190P/N257H/V385S/G395D, T190P/N257H/V385S/Q441S/N445R/N447S/Y449H, T190P/N257H/D389E/G395H/Q441R/N445R/N447A, T190P/N257H/Q399R/N447A/Y449H, T190P/N302H/V385P/D389E/G395D/Q399R/Q441S/N445K/N447S, T190P/D389E, C219L/N257H/V385S/D389E/G395D/Q441R/N447A/Y449H, C219L/N257H/G395H, C219L/V385S/D389E/Q399R/N445R/Y449H, C219L/G395H, N257H/V385P/D389E/Q399R, N257H/D389E/G395D/Q399R/N445K/N447A, N257H/D389E/G395D/Q399R/N445K/Y449H, N257H/D389E/Q399R, N302H/D389E/G395H/N445R, V385S/D389E, V385S/G395D, D389E/G395D/N445R/N447S, G395D/Q399R, and Q399R, wherein the positions are numbered with reference to SEQ ID NO: 1216. In some additional embodiments, the polypeptide sequence of the engineered glycosyltransferase comprises at least one mutation or mutation set at one or more positions selected from 5, 14, 96, 108, 157, 181, 188, 278, 293, and 341, wherein the positions are numbered with reference to SEQ ID NO: 1216. In some additional embodiments, the polypeptide sequence of the engineered glycosyltransferase comprises at least one mutation or mutation set selected from 5S, 14T, 96K, 96P, 108E, 157Q, 181L, 188L, 278L, 293V, and 341L In some additional embodiments, the polypeptide sequence of the engineered glycosyltransferase comprises at least one mutation or mutation set selected from H5S, R14T, G96K, G96P, N108E, N157Q, M181L, E188L, V278L, A293V, and I341L, wherein the positions are numbered with reference to SEQ ID NO: 1216. In some further embodiments, the polypeptide sequence of the engineered glycosyltransferase comprises at least one mutation or mutation set at one or more positions selected from 54/185/190/219/257/302/385/389/395/445/447/449, 54/185/190/385/447/449, 54/190/257/302/385/395/399, 54/190/302/389/395/399/445/447, 54/257/385/449, 54/257/389, and 54/389/395/399/447/449, wherein the positions are numbered with reference to SEQ ID NO: 1216. In some additional embodiments, the polypeptide sequence of the engineered glycosyltransferase comprises at least one mutation or mutation set selected from 54M/185L/190P/219L/257H/302R/385P/389E/395H/445K/447A/449H, 54M/185L/190P/385P/447A/449H, 54M/190P/257H/302R/385P/395A/399R, 54M/190P/302H/389E/395D/399R/445K/447S, 54M/257H/385S/449H, 54M/257H/389E, and 54M/389E/395D/399R/447A/449H, wherein the positions are numbered with reference to SEQ ID NO: 1216. In some additional embodiments, the polypeptide sequence of the engineered glycosyltransferase comprises at least one mutation or mutation set selected from S54M/F185L/T190P/C219L/N257H/N302R/V385P/D389E/G395H/N445K/N447A/Y449H, S54M/F185L/T190P/V385P/N447A/Y449H, S54M/T190P/N257H/N302R/V385P/G395A/Q399R, S54M/T190P/N302H/D389E/G395D/Q399R/N445K/1\1447S, S54M/N257H/V385S/Y449H, S54M/N257H/D389E, and S54M/D389E/G395D/Q399R/N447A/Y449H, wherein the positions are numbered with reference to SEQ ID NO: 1216.

In some further embodiments, the polypeptide sequence of the engineered glycosyltransferase comprises at least one mutation or mutation set at one or more positions selected from 14/42/51/108/181, 14/42/51/157/341, 14/42/341, 14/51/96/157, 14/51/96/157/341, 14/51/96/341, 14/51/108, 14/51/341, 14/96, 14/96/108/133, 14/96/108/181/341, 14/96/108/188, 14/96/341, 14/108/157, 14/108/157/188, 14/157/181/278, 14/278, 42/96/157/341, 42/188/341, 96/108/181/293, 96/108/188, 96/108/188/341, 96/188, 181, 188, and 293, wherein the positions are numbered with reference to SEQ ID NO: 1488. In some additional embodiments, the polypeptide sequence of the engineered glycosyltransferase comprises at least one mutation or mutation set selected from 14T/42T/51V/108E/181L, 14T/42T/51V/157Q/341L, 14T/42T/341L, 14T/51V/96K/157Q, 14T/51V/96P/157Q/341L, 14T/51V/96P/341L, 14T/51V/108E, 14T/51V/341L, 14T/96K, 14T/96K/108E/I331, 14T/96K/108E/188V, 14T/96K/341L, 14T/96P/108E/181L/341L, 14T/108E/157Q, 14T/108E/157Q/188L, 14T/157Q/181L/278L, 14T/278L, 42T/96P/157Q/341L, 42T/188L/341L, 96K/188L, 96P/108E/181L/293V, 96P/108E/188L, 96P/108E/188L/341L, 181L, 188L, and 293V, wherein the positions are numbered with reference to SEQ ID NO: 1488. In some additional embodiments, the polypeptide sequence of the engineered glycosyltransferase comprises at least one mutation or mutation set selected from R14T/V42T/N51V/N108E/M181L, R14T/V42T/N51V/N157Q/341L, R14T/V42T/341L, R14T/N51V/G96K/N157Q, R14T/N51V/G96P/N157Q/341L, R14T/N51V/G96P/341L, R14T/N51V/N108E, R14T/N51V/I341L, R14T/G96K, R14T/G96K/N108E/V33I, R14T/G96K/N108E/E188V, R14T/G96K/341L, R14T/G96P/N108E/M181L/341L, R14T/N108E/N157Q, R14T/N108E/N157Q/E188L, R14T/N157Q/M181L/V278L, R14T/V278L, V42T/G96P/N157Q/I341L, V42T/E188L/I341L, G96K/E188L, G96P/N108E/M181L/A293V, G96P/N108E/E188L, G96P/N108E/E188L/341L, M181L, E188L, and A293V, wherein the positions are numbered with reference to SEQ ID NO: 1488. In some further embodiments, the polypeptide sequence of the engineered glycosyltransferase comprises at least one mutation or mutation set at one or more positions selected from 122, 144, 147, 187, 196, 197, 198, 199, 201, 268, and 324, wherein the positions are numbered with reference to SEQ ID NO: 1488. In some additional embodiments, the polypeptide sequence of the engineered glycosyltransferase comprises at least one mutation or mutation set selected from 122V, 144V, 147F, 187K, 196M, 196P, 196V, 197V, 198A, 198F, 199G, 199Q, 199S, 201P, 268A, 324K, and 324R, wherein the positions are numbered with reference to SEQ ID NO: 1488. In some additional embodiments, the polypeptide sequence of the engineered glycosyltransferase comprises at least one mutation or mutation set selected from L122V, L144V, S147F, T187K, A196M, A196P, A196V, P197V, Q198A, Q198F, N199G, N199Q, N199S, G201P, Y268A, H324K, and H324R, wherein the positions are numbered with reference to SEQ ID NO: 1488. In some further embodiments, the polypeptide sequence of the engineered glycosyltransferase comprises at least one mutation or mutation set at one or more positions selected from 14/42/341, 14/96, 14/96/108/133, 14/96/108/181/341, and 188, wherein the positions are numbered with reference to SEQ ID NO: 1488. In some additional embodiments, the polypeptide sequence of the engineered glycosyltransferase comprises at least one mutation or mutation set selected from 14T/42T/341L, 14T/96K, 14T/96K/108E/I331, 14T/96P/108E/181L/341L, and 188L, wherein the positions are numbered with reference to SEQ ID NO: 1488. In some additional embodiments, the polypeptide sequence of the engineered glycosyltransferase comprises at least one mutation or mutation set selected from R14T/V42T/I341L, R14T/G96K, R14T/G96K/N108E/V133I, R14T/G96P/N108E/M181L/341L, and E188L, wherein the positions are numbered with reference to SEQ ID NO: 1488.

In yet some additional embodiments, the polypeptide sequence of the engineered glycosyltransferase comprises at least one mutation or mutation set at one or more positions selected from 147/188/196/201, 152/187/188/324, 152/188, 152/188/196/198/199/324, 152/188/196/199, 152/188/196/201/324, 152/188/324, 188, 188/196/198/199/201, 188/196/198/199/201/324, 188/196/198/201, 188/196/198/324, 188/196/201, 188/198/199/201/324, 188/198/199/268, 188/198/201/324, 188/198/324, 188/199/201, 188/201, 188/201/324, and 188/324, wherein the positions are numbered with reference to SEQ ID NO: 1516. In some additional embodiments, the polypeptide sequence of the engineered glycosyltransferase comprises at least one mutation or mutation set selected from 147F/188E/196V/201P, 152Y/187K/188E/324K, 152Y/188E, 152Y/188E/196V/198A/199Q/324K, 152Y/188E/196V/199Q, 152Y/188E/196V/201P/324K, 152Y/188E/324K, 188E, 188E/196V/198A/199Q/201P, 188E/196V/198A/324K, 188E/196V/198F/199Q/201P/324K, 188E/196V/198F/201P, 188E/196V/201P, 188E/198A/199Q/268A, 188E/198A/201P/324K, 188E/198A/324K, 188E/198F/199Q/201P/324K, 188E/199Q/201P, 188E/201P, 188E/201P/324K, and 188E/324K, wherein the positions are numbered with reference to SEQ ID NO: 1516. In some additional embodiments, the polypeptide sequence of the engineered glycosyltransferase comprises at least one mutation or mutation set selected from S147F/L188E/A196V/G201P, F152Y/T187K/L188E/H324K, F152Y/L188E, F152Y/L188E/A196V/Q198A/N199Q/H324K, F152Y/L188E/A196V/N199Q, F152Y/L188E/A196V/G201P/H324K, F152Y/L188E/H324K, L188E, L188E/A196V/Q198A/N199Q/G201P, L188E/A196V/Q198A/H324K, L188E/A196V/Q198F/N199Q/G201P/H324K, L188E/A196V/Q198F/G201P, L188E/A196V/G201P, L188E/Q198A/N199Q/Y268A, L188E/Q198A/G201P/H324K, L188E/Q198A/H324K, L188E/Q198F/N199Q/G201P/H324K, L188E/N199Q/G201P, L188E/G201P, L188E/G201P/H324K, and L188E/H324K, wherein the positions are numbered with reference to SEQ ID NO: 1516. In some further embodiments, the polypeptide sequence of the engineered glycosyltransferase comprises at least one mutation or mutation set at one or more positions selected from 152/188/196/198/199/324, 188/196/198/199/201, 188/196/198/201, 188/196/201, 188/198/199/268, 188/201, and 188/324, wherein the positions are numbered with reference to SEQ ID NO: 1516. In some additional embodiments, the polypeptide sequence of the engineered glycosyltransferase comprises at least one mutation or mutation set selected from 152Y/188E/196V/198A/199Q/324K, 188E/196V/198A/199Q/201P, 188E/196V/198F/201P, 188E/196V/201P, 188E/198A/199Q/268A, 188E/201P, and 188E/324K, wherein the positions are numbered with reference to SEQ ID NO: 1516. In some additional embodiments, the polypeptide sequence of the engineered glycosyltransferase comprises at least one mutation or mutation set selected from F152Y/L188E/A196V/Q198A/N199Q/H324K, L188E/A196V/Q198A/N199Q/G201P, L188E/A196V/Q198F/G201P, L188E/A196V/G201P, L188E/Q198A/N199Q/Y268A, L188E/G201P, and L188E/H324K, wherein the positions are numbered with reference to SEQ ID NO: 1516.

The present invention also provides engineered glycosyltransferase provided herein, wherein the engineered glycosyltransferase is selected from beta-1,2-glycosyltransferases and beta-1,3-glycosyltransferases. In some embodiments, the engineered glycosyltransferase is an NDP-glycosyltransferase selected from ADP-glucose-dependent glycosyltransferases (AGTs), CDP-glucose-dependent glycosyltransferases (CGTs), GDP-glucose-dependent glycosyltransferase (GGTs), TDP-glucose-dependent glycosyltransferases (TGTs), and IDP-glucose-dependent glycosyltransferase (IGTs). In some additional embodiments, the engineered glycosyltransferase is an ADP-glucose-dependent glycosyltransferase. In some further embodiments, the engineered glycosyltransferase preferentially uses a sugar donor other than uracil-diphosphate.

The present invention also provides engineered polynucleotides encoding at least one engineered glycosyltransferase polypeptides provided herein. The present invention also provides vectors comprising at least one engineered polynucleotide encoding at least one glycosyltransferase provided herein. In some embodiments, the vector further comprises at least one control sequence. In present invention also provides host cells comprising at least one engineered polynucleotide encoding at least one glycosyltransferase provided herein. The present invention further provides host cells comprising at least one vector provided herein. In some embodiments, the host cell is selected from eukaryotic and prokaryotic organisms.

The present invention also provides methods for producing at least one engineered glycosyltransferase provided herein, comprising culturing a host cell provided herein, under conditions such that the engineered glycosyltransferase is produced by the host cell. In some embodiments, the methods further comprise the step of recovering the engineered glycosyltransferase. The present invention also provides compositions comprising at least one engineered glycosyltransferase provided herein.

The present invention also provides engineered sucrose synthases comprising polypeptide sequences that have at least 90%, 91%, 92%, 93%, 94%, 95%, 96%, 97%, 98%, 99%, or more sequence identity to SEQ ID NO: 6. In some embodiments, the engineered sucrose synthase comprising a polypeptide sequence that has at least 90%, 91%, 92%, 93%, 94%, 95%, 96%, 97%, 98%, 99%, or more sequence identity to SEQ ID NO: 22. In some embodiments, the polypeptide sequence of the engineered sucrose synthase comprises at least one mutation or mutation set at one or more positions selected from 3/548, 4, 7, 12, 41, 42, 44, 47, 52, 57, 59, 71, 81, 85, 93, 97, 122, 129, 134, 136, 139, 154, 175, 215, 266, 270, 343, 358, 381, 388, 434, 442, 519, 524, 532, 536, 570, 589, 603, 606, 615, 635, 641, 652, 724, 727, and 738, wherein the positions are numbered with reference to SEQ ID NO: 22. In some additional embodiments, the polypeptide sequence of the engineered sucrose synthase comprises at least one mutation or mutation set selected from 3G/548R, 4Q, 4T, 7H, 7L, 12K, 41Q, 41S, 42D, 42E, 42I, 44A, 44I, 44L, 44T, 47A, 47G, 47R, 47T, 52G, 52Q, 52S, 52T, 52V, 57H, 57Y, 59M, 59T, 71Q, 71T, 81H, 81P, 81Q, 85T, 93I, 97S, 97T, 122P, 129Q, 134P, 134Q, 134R, 136G, 139G, 154A, 175S, 215L, 266R, 270L, 343L, 358P, 358Q, 381K, 381R, 381T, 381Y, 388A, 388R, 388S, 434G, 434L, 442Y, 519C, 519V, 524R, 524S, 532E, 532T, 532Y, 536T, 570K, 589Q, 603M, 603T, 606A, 606P, 615T, 635G, 635R, 641I, 641L, 652R, 652Y, 724A, 724S, 727H, 738A, and 738K, wherein the positions are numbered with reference to SEQ ID NO: 22. In some additional embodiments, the polypeptide sequence of the engineered sucrose synthase comprises at least one mutation or mutation set selected from E3G/P548R, E4Q, E4T, Q7H, Q7L, S2K, K41Q, K41S, T42D, T42E, T42I, R44A, R44I, R44L, R44T, P47A, P47G, P47R, P47T, P52G, P52Q, P52S, P52T, P52V, W57H, W57Y, A59M, A59T, R71Q, R71T, L81H, L81P, L81Q, V85T, V93I, A97S, A97T, A122P, E129Q, V134P, V134Q, V134R, Q136G, K139G, H154A, G175S, F215L, N266R, V270L, H343L, E358P, E358Q, S381K, S381R, S381T, S381Y, K388A, K388R, K388S, Y434G, Y434L, H442Y, T519C, T519V, A524R, A524S, S532E, S532T, S532Y, E536T, R570K, S589Q, Q603M, Q603T, M606A, M606P, R615T, S635G, S635R, V641I, V641L, G652R, G652Y, K724A, K724S, E727H, S738A, and S738K, wherein the positions are numbered with reference to SEQ ID NO: 22. In some embodiments, the polypeptide sequence of the engineered sucrose synthase comprises at least one mutation or mutation set at one or more positions selected from 41, 52, 134, 381, 442, 519, 524, and 724, wherein the positions are numbered with reference to SEQ ID NO: 22. In some additional embodiments, the polypeptide sequence of the engineered sucrose synthase at least one mutation or mutation set selected from 41S, 52V, 134R, 381R, 442Y, 519V, 524R, and 724S, wherein the positions are numbered with reference to SEQ ID NO: 22. In some additional embodiments, the polypeptide sequence of the engineered sucrose synthase comprises at least one mutation or mutation set selected from K41S, P52V, V134R, S381R, H442Y, T519V, A524R, and K724S, wherein the positions are numbered with reference to SEQ ID NO: 22.

In some further embodiments, the polypeptide sequence of the engineered sucrose synthase comprises at least one mutation or mutation set at one or more positions selected from 25/44/52/134/434/724, 41/44/52/97/442/719/724, 41/44/52/134/442, 41/44/52/434/442/532/724, 41/44/52/434/724, 41/44/136/329, 41/44/136/442, 41/44/532, 41/52/97/434/442/532/724, 41/52/134/136/434, 41/52/134/442/724, 41/52/136, 41/52/434, 41/52/434/442, 41/52/434/442/724, 41/52/442, 41/97/134/434/442/532/553, 41/134/442/532, 41/329/442, 41/434/442/532, 41/434/442/532/724, 41/434/532, 41/532, 44/52/97/434/442/724, 44/52/97/442/724, 44/52/134/136/329/434/442/532, 44/52/134/434/532, 44/136/329/434/532, 44/136/532, 44/434/442/553, 52, 52/97, 52/97/434/442, 52/97/442, 52/97/532, 52/134, 52/134/136/434, 52/134/136/442, 52/134/329/434, 52/134/329/532, 52/134/434/442/532/553, 52/134/442/724, 52/136, 52/136/434, 52/136/434/442, 52/136/434/442/532, 52/136/434/724, 52/136/442, 52/434, 52/434/442/532, 52/434/442/724, 52/434/532, 52/442, 52/442/532/724, 52/442/553/724, 52/442/724, 52/532, 52/553, 57/97/434/442/724, 97/134/136/442/532, 97/134/136/532, 97/134/442, 97/136/434/442, 97/329/724, 97/442, 134, 134/136/434/442, 134/136/434/442/532/553/724, 134/136/434/442/553/724, 134/136/434/532/724, 134/136/442/532, 134/434/442/724, 136, 136/442, 136/442/724, 136/532/724, 434, 434/442, 442, 442/724, and 532/724, wherein the positions are numbered with reference to SEQ ID NO: 1652. In some additional embodiments, the polypeptide sequence of the engineered sucrose synthase comprises at least one mutation or mutation set selected from 25T/44I/52G/134R/434G/724S, 41S/44I/52G/97T/442Y/719T/724S, 41S/44I/52G/434G/442Y/532Y/724S, 41S/44I/52G/434G/724S, 41S/44I/52V/134R/442Y, 41S/44I/136G/329Q, 41S/44I/136G/442Y, 41S/44I/532Y, 41S/52G/134R/442Y/724S, 41S/52G/136G, 41S/52V/97T/434G/442Y/532Y/724S, 41S/52V/134R/136G/434G, 41S/52V/434G, 41S/52V/434G/442Y, 41S/52V/434G/442Y/724S, 41S/52V/442Y, 41S/97T/134R/434G/442Y/532Y/553A, 41S/134R/442Y/532Y, 41S/329Q/442Y, 41S/434G/442Y/532Y, 41S/434G/442Y/532Y/724S, 41S/434G/532Y, 41S/532Y, 44I/52G/134R/136G/329Q/434G/442Y/532Y, 44I/52V/97T/434G/442Y/724S, 44I/52V/97T/442Y/724S, 44I/52V/134R/434G/532Y, 44I/136G/329Q/434G/532Y, 44I/136G/532Y, 44I/434G/442Y/553A, 52G, 52G/97T, 52G/97T/434G/442Y, 52G/97T/442Y, 52G/97T/532Y, 52G/134R, 52G/134R/136G/434G, 52G/134R/136G/442Y, 52G/134R/329Q/434G, 52G/134R/434G/442Y/532Y/553A, 52G/136G, 52G/434G/442Y/532Y, 52G/442Y, 52G/442Y/553A/724S, 52G/442Y/724S, 52G/532Y, 52G/553A, 52V/134R/329Q/532Y, 52V/134R/442Y/724S, 52V/136G/434G, 52V/136G/434G/442Y, 52V/136G/434G/442Y/532Y, 52V/136G/434G/724S, 52V/136G/442Y, 52V/434G, 52V/434G/442Y/724S, 52V/434G/532Y, 52V/442Y, 52V/442Y/532Y/724S, 52V/442Y/553A/724S, 52V/442Y/724S, 52V/532Y, 57C/97T/434G/442Y/724S, 97T/134R/136G/442Y/532Y, 97T/134R/136G/532Y, 97T/134R/442Y, 97T/136G/434G/442Y, 97T/329Q/724S, 97T/442Y, 134R, 134R/136G/434G/442Y, 134R/136G/434G/442Y/532Y/553A/724S, 134R/136G/434G/442Y/553A/724S, 134R/136G/434G/532Y/724S, 134R/136G/442Y/532Y, 134R/434G/442Y/724S, 136G, 136G/442Y, 136G/442Y/724S, 136G/532Y/724S, 434G, 434G/442Y, 442Y, 442Y/724S, and 532Y/724S, wherein the positions are numbered with reference to SEQ ID NO: 1652. In some additional embodiments, the polypeptide sequence of the engineered sucrose synthase comprises at least one mutation or mutation set selected from A25T/R44I/P52G/V134R/Y434G/K724S, K41S/R44I/P52G/A97T/H442Y/A719T/K724S, K41S/R44I/P52G/Y434G/H442Y/S532Y/K724S, K41S/R44I/P52G/Y434G/K724S, K41S/R44I/P52V/V134R/H442Y, K41S/R44I/Q136G/E329Q, K41S/R44I/Q136G/H442Y, K41S/R44I/S532Y, K41S/P52G/V134R/H442Y/K724S, K41S/P52G/Q136G, K41S/P52V/A97T/Y434G/H442Y/S532Y/K724S, K41S/P52V/V134R/Q136G/Y434G, K41S/P52V/Y434G, K41S/P52V/Y434G/H442Y, K41S/P52V/Y434G/H442Y/K724S, K41S/P52V/H442Y, K41S/A97T/V134R/Y434G/H442Y/S532Y/V553A, K41S/V134R/H442Y/S532Y, K41S/E329Q/H442Y, K41S/Y434G/H442Y/S532Y, K41S/Y434G/H442Y/S532Y/K724S, K41S/Y434G/S532Y, K41S/S532Y, R44I/P52G/V134R/Q136G/E329Q/Y434G/H442Y/S532Y, R44I/P52V/A97T/Y434G/H442Y/K724S, R44I/P52V/A97T/H442Y/K724S, R44I/P52V/V134R/Y434G/S532Y, R44I/Q136G/E329Q/Y434G/S532Y, R44I/Q136G/S532Y, R44I/Y434G/H442Y/V553A, P52G, P52G/A97T, P52G/A97T/Y434G/H442Y, P52G/A97T/H442Y, P52G/A97T/S532Y, P52G/V134R, P52G/V134R/Q136G/Y434G, P52G/V134R/Q136G/H442Y, P52G/V134R/E329Q/Y434G, P52G/V134R/Y434G/H442Y/S532Y/V553A, P52G/Q136G, P52G/Y434G/H442Y/S532Y, P52G/H442Y, P52G/H442Y/V553A/K724S, P52G/H442Y/K724S, P52G/S532Y, P52G/V553A, P52V/V134R/E329Q/S532Y, P52V/V134R/H442Y/K724S, P52V/Q136G/Y434G, P52V/Q136G/Y434G/H442Y, P52V/Q136G/Y434G/H442Y/S532Y, P52V/Q136G/Y434G/K724S, P52V/Q136G/H442Y, P52V/Y434G, P52V/Y434G/H442Y/K724S, P52V/Y434G/S532Y, P52V/H442Y, P52V/H442Y/S532Y/K724S, P52V/H442Y/V553A/K724S, P52V/H442Y/K724S, P52V/S532Y, W57C/A97T/Y434G/H442Y/K724S, A97T/V134R/Q136G/H442Y/S532Y, A97T/V134R/Q136G/S532Y, A97T/V134R/H442Y, A97T/Q136G/Y434G/H442Y, A97T/E329Q/K724S, A97T/H442Y, V134R, V134R/Q136G/Y434G/H442Y, V134R/Q136G/Y434G/H442Y/S532Y/V553A/K724S, V134R/Q136G/Y434G/H442Y/V553A/K724S, V134R/Q136G/Y434G/S532Y/K724S, V134R/Q136G/H442Y/S532Y, V134R/Y434G/H442Y/K724S, Q136G, Q136G/H442Y, Q136G/H442Y/K724S, Q136G/S532Y/K724S, Y434G, Y434G/H442Y, H442Y, H442Y/K724S, and S532Y/K724S, wherein the positions are numbered with reference to SEQ ID NO: 1652. In some additional embodiments, the polypeptide sequence of the engineered sucrose synthase comprises at least one mutation or mutation set at one or more positions selected from 3, 4, 22, 32, 34, 38, 47/488, 51, 51/433, 62, 75/169, 101, 169, 195/213, 708, and 718, wherein the positions are numbered with reference to SEQ ID NO: 1652. In some additional embodiments, the polypeptide sequence of the engineered sucrose synthase comprises at least one mutation or mutation set selected from 3A, 4V, 22L, 22T, 32S, 34E, 34S, 38L, 38N, 38V, 38W, 47S/488N, 51A, 51H, 51H/433P, 51T, 62I, 75I/169A, 101V, 169E, 195K/213T, 708V, and 718H, wherein the positions are numbered with reference to SEQ ID NO: 1652. In some additional embodiments, the polypeptide sequence of the engineered sucrose synthase comprises at least one mutation or mutation set selected from E3A, E4V, H22L, H22T, L32S, T34E, T34S, R38L, R38N, R38V, R38W, P47S/D488N, Y51A, Y51H, Y51H/L433P, Y51T, V62I, M75I/Q169A, L101V, Q169E, S195K/A213T, T708V, and A718H, wherein the positions are numbered with reference to SEQ ID NO: 1652. In some further embodiments, the polypeptide sequence of the engineered sucrose synthase comprises at least one mutation or mutation set at one or more positions selected from 44/52/97/442/724, 52/97/442, 97/442, and 434/442, wherein the positions are numbered with reference to SEQ ID NO: 1652. In some additional embodiments, the polypeptide sequence of the engineered sucrose synthase comprises at least one mutation or mutation set selected from 44I/52V/97T/442Y/724S, 52G/97T/442Y, 97T/442Y, and 434G/442Y, wherein the positions are numbered with reference to SEQ ID NO: 1652. In some additional embodiments, the polypeptide sequence of the engineered sucrose synthase comprises at least one mutation or mutation set selected from R44I/P52V/A97T/H442Y/K724S, P52G/A97T/H442Y, A97T/H442Y, and Y434G/H442Y, wherein the positions are numbered with reference to SEQ ID NO: 1652.

In yet some further embodiments, the polypeptide sequence of the engineered sucrose synthase comprises at least one mutation or mutation set at one or more positions selected from 4/22, 4/22/34, 4/22/34/38, 4/22/34/38/169/708, 4/22/34/47/51/169/213, 4/22/51/708, 4/22/101, 4/34/38/101, 4/34/708, 4/62/433/708, 4/169, 4/169/433, 4/169/708, 4/433, 4/708, 22/34, 22/34/38, 22/34/101/169, 22/34/101/169/195, 22/34/169/708, 22/47/169/433, 22/75, 34/38/62, 34/62/169/433, 34/101, 62/708, 75/169, 169/708, and 195/708, wherein the positions are numbered with reference to SEQ ID NO: 1822. In some additional embodiments, the polypeptide sequence of the engineered sucrose synthase comprises at least one mutation or mutation set selected from 4V/22L/34E, 4V/22L/51A/708V, 4V/22L/101V, 4V/22T, 4V/22T/34E/38N, 4V/22T/34E/38V/169A/708V, 4V/22T/34E/47S/51H/169A/213T, 4V/34E/38N/101V, 4V/34E/708V, 4V/62I/433P/708V, 4V/169A, 4V/169A/433P, 4V/169A/708V, 4V/433P, 4V/708V, 22L/34E, 22L/34S/169A/708V, 22L/75I, 22T/34E/38V, 22T/34E/101V/169E, 22T/34E/101V/169E/195K, 22T/47S/169A/433P, 34E/62I/169E/433P, 34E/101V, 34S/38 L/62I, 62I/708V, 75I/169A, 169A/708V, and 195K/708V, wherein the positions are numbered with reference to SEQ ID NO: 1822. In some additional embodiments, the polypeptide sequence of the engineered sucrose synthase comprises at least one mutation or mutation set selected from E4V/H22L/T34E, E4V/H22L/Y51A/T708V, E4V/H22L/L101V, E4V/H22T, E4V/H22T/T34E/R38N, E4V/H22T/T34E/R38V/Q169A/T708V, E4V/H22T/T34E/P47S/Y51H/Q169A/A213T, E4V/T34E/R38N/L101V, E4V/T34E/T708V, E4V/V62I/L433P/T708V, E4V/Q169A, E4V/Q169A/L433P, E4V/Q169A/T708V, E4V/L433P, E4V/T708V, H22L/T34E, H22L/T34S/Q169A/T708V, H22L/M75I, H22T/T34E/R38V, H22T/T34E/L101V/Q169E, H22T/T34E/L101V/Q169E/S195K, H22T/P47S/Q169A/L433P, T34E/V62I/Q169E/L433P, T34E/L101V, T34S/R38L/V62I, V62I/T708V, M75I/Q169A, Q169A/T708V, and S195K/T708V, wherein the positions are numbered with reference to SEQ ID NO: 1822. In some additional embodiments, the polypeptide sequence of the engineered sucrose synthase comprises at least one mutation or mutation set at one or more positions selected from 4, 22, 34, 121, 169, 341, 411, 433, 441, 518, 526, 527, 528, 544, 557, 558, 565, 585, 602, 604, 623, 708, 731, and 770, wherein the positions are numbered with reference to SEQ ID NO: 1822. In some additional embodiments, the polypeptide sequence of the engineered sucrose synthase comprises at least one mutation or mutation set selected from 4V, 22L, 22T, 34E, 121D, 169A, 341N, 411I, 433P, 441A, 441L, 518S, 526H, 526V, 527A, 527Q, 528Q, 544H, 557P, 558G, 565V, 585A, 602P, 604A, 623A, 623K, 623Q, 623R, 708V, 731A, 731M, 731Q, 731T, and 770T, wherein the positions are numbered with reference to SEQ ID NO: 1822. In some additional embodiments, the polypeptide sequence of the engineered sucrose synthase comprises at least one mutation or mutation set selected from E4V, H22L, H22T, T34E, E121D, Q169A, P341N, L411I, L433P, D441A, D441L, R518S, T526H, T526V, E527A, E527Q, E528Q, R544H, R557P, Q558G, M565V, S585A, V602P, N604A, H623A, H623K, H623Q, H623R, T708V, D731A, D731M, D731Q, D731T, and V770T, wherein the positions are numbered with reference to SEQ ID NO: 1822. In some additional embodiments, the polypeptide sequence of the engineered sucrose synthase comprises at least one mutation or mutation set at one or more positions selected from 4, 4/22/34/38, 4/169, 4/169/433, 4/433, 62/708, and 169/708, wherein the positions are numbered with reference to SEQ ID NO: 1822. In some additional embodiments, the polypeptide sequence of the engineered sucrose synthase comprises at least one mutation or mutation set selected from 4V, 4V/22T/34E/38N, 4V/169A, 4V/169A/433P, 4V/433P, 62I/708V, and 169A/708V, wherein the positions are numbered with reference to SEQ ID NO: 1822. In some additional embodiments, the polypeptide sequence of the engineered sucrose synthase comprises at least one mutation or mutation set selected from E4V, E4V/H22T/T34E/R38N, E4V/Q169A, E4V/Q169A/L433P, E4V/L433P, V62I/T708V, and Q169A/T708V, wherein the positions are numbered with reference to SEQ ID NO: 1822.

In yet some additional embodiments, the polypeptide sequence of the engineered sucrose synthase comprises at least one mutation or mutation set at one or more positions selected from 34/62/411/526/557, 34/62/411/557/602/604, 34/62/441/557/623, 34/62/518/623, 34/62/623/731, 34/121/441/544/604/623, 34/121/526/604/731, 34/411/441, 34/411/441/518/526/557/565/731, 34/411/441/518/544/557/565/708/731, 34/411/441/518/585/604/770, 34/441/518/526/585/604/731, 34/441/526/565/708/770, 34/441/544/557/585/602/623, 34/441/585/623/708/731, 34/526/585/623, 62/121/329/518/557/565/623/708, 62/121/411/441/518/544/557/585/604/623, 62/121/441/518/526/623/770, 62/121/441/565/585, 62/121/518/557/585/604/708/770, 62/411/526/565/604/623, 62/411/585/731, 62/441/518/557/604/623/708/731, 62/441/623/708/770, 62/441/770, 121/441/518/526/602/604, 121/441/518/526/623/708, 121/441/526/557/565/708, 121/604/708/731/770, 411/441/518/557/623, 411/441/518/708, 411/441/604/623/708/731, 411/518/526/604/623/731, 411/565/604/623, 411/585/623, 441/518/526/557/565/602/604/623/708, 441/518/526/557/585/604/623/708, 441/518/526/604/623, 441/518/557/565/585, 441/518/565/623/731/770, 441/518/585, 441/585, 441/585/602/604/623/708/731, 441/708/731, 557/602/604, 557/604, 585/623/708, and 623, wherein the positions are numbered with reference to SEQ ID NO: 2092.

In some additional embodiments, the polypeptide sequence of the engineered sucrose synthase comprises at least one mutation or mutation set selected from 34E/62I/411I/526H/557P, 34E/62I/411I/557P/602P/604A, 34E/62I/441L/557P/623K, 34E/62I/518S/623K, 34E/62I/623K/731Q, 34E/121D/441L/544H/604A/623K, 34E/121D/526H/604A/731Q, 34E/411I/441L, 34E/411I/441L/518S/526H/557P/565V/731Q, 34E/411I/441L/518S/544H/557P/565V/708V/731Q, 34E/411I/441L/518S/585A/604A/770T, 34E/441L/518S/526H/585A/604A/731Q, 34E/441L/526H/565V/708V/770T, 34E/441L/544H/557P/585A/602P/623K, 34E/441L/585A/623K/708V/731Q, 34E/526H/585A/623K, 62I/121D/329Q/518S/557P/565V/623R/708V, 62I/121D/411I/441L/518S/544H/557P/585A/604A/623K, 62I/121D/441L/518S/526H/623R/770T, 62I/121D/441L/518S/565V/585A, 62I/121D/518S/557P/585A/604A/708V/770T, 62I/411I/526H/565V/604A/623K, 62I/411I/585A/731Q, 62I/441L/518S/557P/604A/623R/708V/731Q, 62I/441L/623R/708V/770T, 62I/441L/770T, 121D/441L/518S/526H/602P/604A, 121D/441L/518S/526H/623K/708V, 121D/441L/526H/557P/565V/708V, 121D/604A/708V/731Q/770T, 411I/441L/518S/557P/623K, 411I/441L/518S/708V, 411I/441L/604A/623K/708V/731Q, 411I/518S/526H/604A/623K/731Q, 411I/565V/604A/623R, 411I/585A/623K, 441L/518S/526H/557P/565V/602P/604A/623K/708V, 441L/518S/526H/557P/585A/604A/623R/708V, 441L/518S/526H/604A/623R, 441L/518S/557P/565V/585A, 441L/518S/565V/623R/731Q/770T, 441L/518S/585A, 441L/585A, 441L/585A/602P/604A/623R/708V/731Q, 441L/708V/731Q, 557P/602P/604A, 557P/604A, 585A/623R/708V, and 623R, wherein the positions are numbered with reference to SEQ ID NO: 2092. In some additional embodiments, the polypeptide sequence of the engineered sucrose synthase comprises at least one mutation or mutation set selected from T34E/V62I/L411I/T526H/R557P, T34E/V62I/L411I/R557P/V602P/N604A, T34E/V62I/D441L/R557P/H623K, T34E/V62I/R518S/H623K, T34E/V62I/H623K/D731Q, T34E/E121D/D441L/R544H/N604A/H623K, T34E/E121D/T526H/N604A/D731Q, T34E/L411I/D441L, T34E/L411I/D441L/R518S/T526H/R557P/M565V/D731Q, T34E/L411I/D441L/R518S/R544H/R557P/M565V/T708V/D731Q, T34E/L411I/D441L/R518S/S585A/N604A/V770T, T34E/D441L/R518S/T526H/S585A/N604A/D731Q, T34E/D441L/T526H/M565V/T708V/V770T, T34E/D441L/R544H/R557P/S585A/V602P/H623K, T34E/D441L/S585A/H623K/T708V/D731Q, T34E/T526H/S585A/H623K, V62I/E121D/E329Q/R518S/R557P/M565V/H623R/T708V, V62I/E121D/L411I/D441L/R518S/R544H/R557P/S585A/N604A/H623K, V62I/E121D/D441L/R518S/T526H/H623R/V770T, V62I/E121D/D441L/M565V/S585A, V62I/E121D/R518S/R557P/S585A/N604A/T708V/V770T, V62I/L411I/T526H/M565V/N604A/H623K, V62I/L411I/S585A/D731Q, V62I/D441L/R518S/R557P/N604A/H623K/T708V/D731Q, V62I/D441L/H623R/T708V/V770T, V62I/D441L/V770T, E121D/D441L/R518S/T526H/V602P/N604A, E121D/D441L/R518S/T526H/H623K/T708V, E121D/D441L/T526H/R557P/M565V/T708V, E121D/N604A/T708V/D731Q/V770T, L411I/D441L/R518S/R557P/H623K, L411I/D441L/R518S/T708V, L411I/D441L/N604A/H623K/T708V/D731Q, L411I/R518S/T526H/N604A/H623K/D731Q, L411I/M565V/N604A/H623R, L411I/S585A/H623K, D441L/R518S/T526H/R557P/M565V/V602P/N604A/H623K/T708V, D441L/R518S/T526H/R557P/S585A/N604A/H623R/T708V, D441L/R518S/T526H/N604A/H623R, D441L/R518S/R557P/M565V/S585A, D441L/R518S/M565V/H623R/D731Q/V770T, D441L/R518S/S585A, D441L/S585A, D441L/S585A/V602P/N604A/H623R/T708V/D731Q, D441L/T708V/D731Q, R557P/V602P/N604A, R557P/N604A, S585A/H623R/T708V, and H623R, wherein the positions are numbered with reference to SEQ ID NO: 2092. In yet some further embodiments, the polypeptide sequence of the engineered sucrose synthase comprises at least one mutation or mutation set at one or more positions selected from 63, 65, 269, 323, 406, 416, 469, 511, and 640, wherein the positions are numbered with reference to SEQ ID NO: 2092. In some additional embodiments, the polypeptide sequence of the engineered sucrose synthase comprises at least one mutation or mutation set selected from 63G, 63S, 63T, 65C, 65L, 269V, 323G, 323S, 323T, 406G, 416F, 469S, 511L, 640A, 640E, 640H, 640N, 640R, 640V, and 640W, wherein the positions are numbered with reference to SEQ ID NO: 2092. In some additional embodiments, the polypeptide sequence of the engineered sucrose synthase comprises at least one mutation or mutation set selected from A63G, A63S, A63T, T65C, T65L, I269V, A323G, A323S, A323T, N406G, L416F, T469S, V511L, T640A, T640E, T640H, T640N, T640R, T640V, and T640W, wherein the positions are numbered with reference to SEQ ID NO: 2092. In some further embodiments, the polypeptide sequence of the engineered sucrose synthase comprises at least one mutation or mutation set at one or more positions selected from 34/62/441/557/623, 34/441/585/623/708/731, 62/441/623/708/770, 411/441/518/557/623, 411/441/604/623/708/731, 441/518/526/557/585/604/623/708, 441/518/557/565/585, and 441/585/602/604/623/708/731, wherein the positions are numbered with reference to SEQ ID NO: 2092. In some additional embodiments, the polypeptide sequence of the engineered sucrose synthase comprises at least one mutation or mutation set selected from 34E/62I/441L/557P/623K, 34E/441L/585A/623K/708V/731Q, 62I/441L/623R/708V/770T, 411I/441L/518S/557P/623K, 411I/441L/604A/623K/708V/731Q, 441L/518S/526H/557P/585A/604A/623R/708V, 441L/518S/557P/565V/585A, and 441L/585A/602P/604A/623R/708V/731Q, wherein the positions are numbered with reference to SEQ ID NO: 2092. In some additional embodiments, the polypeptide sequence of the engineered sucrose synthase comprises at least one mutation or mutation set selected from T34E/V62I/D441L/R557P/H623K, T34E/D441L/S585A/H623K/T708V/D731Q, V62I/D441L/H623R/T708V/V770T, L411I/D441L/R518S/R557P/H623K, L411I/D441L/N604A/H623K/T708V/D731Q, D441L/R518S/T526H/R557P/S585A/N604A/H623R/T708V, D441L/R518S/R557P/M565V/S585A, and D441L/S585A/V602P/N604A/H623R/T708V/D731Q, wherein the positions are numbered with reference to SEQ ID NO: 2092.

In some further embodiments, the polypeptide sequence of the engineered sucrose synthase comprises at least one mutation or mutation set at one or more positions selected from 34, 34/62, 34/62/65/640, 34/62/323, 34/63/65/323/528/640, 34/63/65/406/528/640/713, 34/63/323/526/528/640, 34/63/406/528/640/731, 34/65, 34/65/528/640, 34/323/406/640, 34/323/640, 34/640, 38/640, 62/63, 62/63/65/528/640, 62/63/69/323/406/640, 62/63/526/640/731, 62/323/640, 63/65/323/406/526/528/640/731, 63/65/406/731, 63/65/528/640/731, 63/65/640, 63/323/406/640, 63/406, 63/406/640, 63/526/528/640/731, 63/731, 323/406/640, 323/406/640/731, 323/526/528/640, 323/526/640, 323/640/731, 406/640, 526/528/640/731, and 731, wherein the positions are numbered with reference to SEQ ID NO: 2182. In some additional embodiments, the polypeptide sequence of the engineered sucrose synthase comprises at least one mutation or mutation set selected from 34E, 34E/62I, 34E/62I/65C/640R, 34E/62I/323G, 34E/63S/65C/406G/528D/640R/713V, 34E/63S/323G/526T/528D/640R, 34E/63S/406G/528D/640N/731Q, 34E/63T/65C/323G/528D/640R, 34E/65C, 34E/65C/528D/640R, 34E/323G/406/640A, 34E/323G/640A, 34E/640A, 34E/640R, 38H/640R, 62I/63S/65C/528D/640A, 62I/63S/526T/640R/731Q, 62I/63T, 62I/63T/69F/323G/406G/640R, 62I/323G/640R, 63S/65C/640R, 63S/323G/406G/640A, 63S/406G, 63S/526T/528D/640R/731Q, 63S/731Q, 63T/65C/323G/406G/526T/528D/640N/731Q, 63T/65C/406G/731Q, 63T/65C/528D/640A/731Q, 63T/406G/640A, 323G/406G/640N, 323G/406G/640R/731Q, 323G/526T/528D/640R, 323G/526T/640R, 323G/640A/731Q, 406G/640R, 526T/528D/640A/731Q, and 731Q, wherein the positions are numbered with reference to SEQ ID NO: 2182. In some additional embodiments, the polypeptide sequence of the engineered sucrose synthase comprises at least one mutation or mutation set selected from T34E, T34E/V62I, T34E/V62I/T65C/T640R, T34E/V62I/A323G, T34E/A63S/T65C/N406G/E528D/T640R/A713V, T34E/A63S/A323G/H526T/E528D/T640R, T34E/A63S/N406G/E528D/T640N/D731Q, T34E/A63T/T65C/A323G/E528D/T640R, T34E/T65C, T34E/T65C/E528D/T640R, T34E/A323G/N406G/T640A, T34E/A323G/T640A, T34E/T640A, T34E/T640R, R38H/T640R, V62I/A63S/T65C/E528D/T640A, V62I/A63S/H526T/T640R/D731Q, V62I/A63T, V62I/A63T/I69F/A323G/N406G/T640R, V62I/A323G/T640R, A63S/T65C/T640R, A63S/A323G/N406G/T640A, A63S/N406G, A63S/H526T/E528D/T640R/D731Q, A63S/D731Q, A63T/T65C/A323G/N406G/H526T/E528D/T640N/D731Q, A63T/T65C/N406G/D731Q, A63T/T65C/E528D/T640A/D731Q, A63T/N406G/T640A, A323G/N406G/T640N, A323G/N406G/T640R/D731Q, A323G/H526T/E528D/T640R, A323G/H526T/T640R, A323G/T640A/D731Q, N406G/T640R, H526T/E528D/T640A/D731Q, and D731Q, wherein the positions are numbered with reference to SEQ ID NO: 2182. In some further embodiments, the polypeptide sequence of the engineered sucrose synthase comprises at least one mutation or mutation set at one or more positions selected from 28, 30, 30/158, 37, 59, 102, 108, 158, 164, 183, 191, 206, 235, 307, 311, 409, 419, 533, 543, 546, 559, 683, 710, 752, and 793, wherein the positions are numbered with reference to SEQ ID NO: 2182. In some additional embodiments, the polypeptide sequence of the engineered sucrose synthase comprises at least one mutation or mutation set selected from 28H, 30A, 30H/158H, 30M, 30Q, 37L, 37M, 59T, 102N, 102T, 108R, 158A, 158K, 164G, 164Q, 164S, 164T, 183P, 191L, 206I, 235A, 307E, 307H, 311L, 311S, 409S, 419L, 419V, 533K, 533R, 543A, 546N, 546Q, 546T, 559R, 683L, 683V, 710A, 710G, 710S, 710V, 752R, and 793G, wherein the positions are numbered with reference to SEQ ID NO: 2182. In some additional embodiments, the polypeptide sequence of the engineered sucrose synthase comprises at least one mutation or mutation set selected from R28H, S30A, S30H/R158H, S30M, S30Q, Q37L, Q37M, A59T, S102N, S102T, Q108R, R158A, R158K, A164G, A164Q, A164S, A164T, N183P, T191L, L206I, V235A, N307E, N307H, Q311L, Q311S, A409S, T419L, T419V, L533K, L533R, G543A, P546N, P546Q, P546T, K559R, R683L, R683V, E710A, E710G, E710S, E710V, T752R, and E793G, wherein the positions are numbered with reference to SEQ ID NO: 2182. In some further embodiments, the polypeptide sequence of the engineered sucrose synthase comprises at least one mutation or mutation set at one or more positions selected from 34/62, 34/65, 34/323/640, 34/640, 38/640, and 63/65/406/731, wherein the positions are numbered with reference to SEQ ID NO: 2182. In some additional embodiments, the polypeptide sequence of the engineered sucrose synthase comprises at least one mutation or mutation set selected from 34E/62I, 34E/65C, 34E/323G/640A, 34E/640A, 38H/640R, and 63T/65C/406G/731Q, wherein the positions are numbered with reference to SEQ ID NO: 2182. In some additional embodiments, the polypeptide sequence of the engineered sucrose synthase comprises at least one mutation or mutation set selected from T34E/V62I, T34E/T65C, T34E/A323G/T640A, T34E/T640A, R38H/T640R, and A63T/T65C/N406G/D731Q, wherein the positions are numbered with reference to SEQ ID NO: 2182.

In yet some further embodiments, the polypeptide sequence of the engineered sucrose synthase comprises at least one mutation or mutation set at one or more positions selected from 34/65/323/406/411/565, 34/323/406/411/565, 34/323/406/565/731, 62/65/323/406/565, 62/65/323/406/565/731, 62/65/323/411/565, 62/65/406/411/565/731, 62/323/406/411, 62/323/406/411/565, 62/323/411/565, 63/65/323/406/565/731, 63/65/406/411/565, 65/323/406/565, 323/406/411/565, 323/411/565, and 636, wherein the positions are numbered with reference to SEQ ID NO: 2322. In some additional embodiments, the polypeptide sequence of the engineered sucrose synthase comprises at least one mutation or mutation set selected from 34E/65C/323G/406G/411I/565V, 34E/323G/406G/411I/565V, 34E/323G/406G/565V/731Q, 62I/65C/323G/406G/565V, 62I/65C/323G/406G/565V/731Q, 62I/65C/323G/411I/565V, 62I/65C/406G/411I/565V/731Q, 62I/323G/406G/411I, 62I/323G/406G/411I/565V, 62I/323G/411I/565V, 63T/65C/323G/406G/565V/731Q, 63T/65C/406G/411I/565V, 65C/323G/406G/565V, 323G/406G/411I/565V, 323G/411I/565V, 636A, 636H, and 636N, wherein the positions are numbered with reference to SEQ ID NO: 2322. In some additional embodiments, the polypeptide sequence of the engineered sucrose synthase comprises at least one mutation or mutation set selected from T34E/T65C/A323G/N406G/L411I/M565V, T34E/A323G/N406G/L411I/M565V, T34E/A323G/N406G/M565V/D731Q, V62I/T65C/A323G/N406G/M565V, V62I/T65C/A323G/N406G/M565V/D731Q, V62I/T65C/A323G/L411I/M565V, V62I/T65C/N406G/L411I/M565V/D731Q, V62I/A323G/N406G/L411I, V62I/A323G/N406G/L411I/M565V, V62I/A323G/L411I/M565V, A63T/T65C/A323G/N406G/M565V/D731Q, A63T/T65C/N406G/L411I/M565V, T65C/A323G/N406G/M565V, A323G/N406G/L411I/M565V, A323G/L411I/M565V, Q636A, Q636H, and Q636N, wherein the positions are numbered with reference to SEQ ID NO: 2322. In some further embodiments, the polypeptide sequence of the engineered sucrose synthase comprises at least one mutation or mutation set at one or more positions selected from 34/65/323/406/411/565, 34/323/406/411/565, 62/65/323/406/565, 62/65/406/411/565/636/731, 62/65/406/411/565/731, 62/323/406/411, 62/323/406/411/565, and 62/323/411/565, wherein the positions are numbered with reference to SEQ ID NO: 2322. In some additional embodiments, the polypeptide sequence of the engineered sucrose synthase comprises at least one mutation or mutation set selected from 34E/65C/323G/406G/411I/565V, 34E/323G/406G/411I/565V, 62I/65C/323G/406G/565V, 62I/65C/406G/411I/565V/636H/731Q, 62I/65C/406G/411I/565V/731Q, 62I/323G/406G/411I, 62I/323G/406G/411I/565V, and 62I/323G/411I/565V, wherein the positions are numbered with reference to SEQ ID NO: 2322. In some additional embodiments, the polypeptide sequence of the engineered sucrose synthase comprises at least one mutation or mutation set selected from T34E/T65C/A323G/N406G/L411I/M565V, T34E/A323G/N406G/L411I/M565V, V62I/T65C/A323G/N406G/M565V, V62I/T65C/N406G/L411I/M565V/Q636H/D731Q, V62I/T65C/N406G/L411I/M565V/D731Q, V62I/A323G/N406G/L411I, V62I/A323G/N406G/L411I/M565V, and V62I/A323G/L411I/M565V, wherein the positions are numbered with reference to SEQ ID NO: 2322.

The present invention also provides engineered polynucleotides encoding at least one engineered sucrose synthase polypeptide provided herein. The present invention further provides vectors comprising at least one engineered polynucleotide encoding at least one engineered sucrose synthase provided herein. In some embodiments, the vectors further comprise at least one control sequence. The present invention also provides host cells comprising at least one engineered polynucleotide encoding at least one sucrose synthase. In some embodiments, the host cell comprises at least one vector comprising at least one polynucleotide encoding at least one sucrose synthase. In some embodiments, the host cell is selected from eukaryotic and prokaryotic organisms. The present invention also provides methods for producing at least one engineered sucrose synthase variant provided herein, comprising culturing a host cell provided herein, under conditions such that the engineered sucrose synthase variant is produced by the host cell. In some embodiments, the methods further comprise the step of recovering the engineered sucrose synthase variant. The present invention also provides compositions comprising at least one engineered sucrose synthase variant provided herein.

The present invention also provides methods for glycosylation of a substrate comprising providing at least one substrate, at least one engineered glycosyl transferase provided herein, and contacting the substrate with the glycosyltransferase under conditions such that the substrate is glycosylated to produce at least one glycosylated product. In some embodiments, the substrate comprises at least one steviol glycoside. In some additional embodiments, the glycosylated product comprises at least one mono-glycosylated and/or polyglycosylated product.

The present invention also provides methods for producing rebaudioside M, comprising providing a rebaudioside D and/or rebaudioside I substrate, NDP-glucose, and a least one engineered glycosyltransferase provided herein, combining the rebaudioside D and rebaudioside I substrate, NDP-glucose, and the glycosyltransferase under conditions such that rebaudioside M is produced.

The present invention also provides methods for producing rebaudioside A and/or rebaudioside I, comprising providing a stevioside substrate, NDP-glucose, and at least one engineered glycosyltransferase provided herein, combining the stevioside substrate, NDP-glucose, and glycosyltransferase under conditions such that rebaudioside A and/or rebaudioside I is produced.

The present invention also provides methods for producing rebaudioside D, comprising providing a stevioside substrate, NDP-glucose, and at least one engineered glycosyltransferase provided herein, combining the stevioside substrate, NDP-glucose, and glycosyltransferase under conditions such that rebaudioside D is produced.

In some embodiments of the methods provided herein, the NDP-glucose is selected from ADP-glucose, CDP-glucose, TDP-glucose, GDP-glucose, and/or IDT-glucose. In some further embodiments, the NDP-glucose is not UDP-glucose.

The present invention also provides methods for producing rebaudioside M comprising providing a rebaudioside D and/or rebaudioside I substrate, ADP-glucose, and at least one engineered glycosyltransferase provided herein, combining the rebaudioside D and/or rebaudioside I substrate, ADP-glucose, and glycosyltransferase under conditions such that rebaudioside M is produced.

The present invention also provides methods for producing rebaudioside A and/or rebaudioside I, comprising providing a stevioside substrate, ADP-glucose, and at least one engineered ADP-glycosyltransferase provided herein, combining the stevioside substrate, ADP-glucose, and glycosyltransferase under conditions such that rebaudioside A and/or rebaudioside I is produced.

The present invention also provides methods for producing rebaudioside D, comprising providing a stevioside substrate, ADP-glucose, and at least one engineered glycosyltransferase provided herein, combining the stevioside substrate, ADP-glucose, and glycosyltransferase under conditions such that rebaudioside D is produced.

The present invention also provides methods for producing rebaudioside M comprising providing a rebaudioside D and/or rebaudioside I substrate, NDP, sucrose, a sucrose synthase, and at least one engineered glycosyltransferase provided herein, combining the rebaudioside D substrate, NDP, sucrose, sucrose synthase, and glycosyltransferase under conditions such that rebaudioside M is produced.

The present invention also provides methods for producing rebaudioside A and/or rebaudioside I comprising providing a stevioside substrate, NDP, sucrose, a sucrose synthase, and at least one engineered glycosyltransferase provided herein, combining the stevioside substrate, NDP, sucrose, sucrose synthase, and glycosyltransferase under conditions such that rebaudioside A and/or rebaudioside I is produced.

The present invention also provides methods for producing rebaudioside D, comprising providing a stevioside substrate, NDP, sucrose, a sucrose synthase, and at least one engineered glycosyltransferase provided herein, combining the stevioside substrate, NDP, sucrose, sucrose synthase, and glycosyltransferase under conditions such that rebaudioside D is produced.

The present invention also provides methods for producing rebaudioside M, comprising providing a stevioside substrate comprising at least one stevioside and/or a mixture of steviosides and rebA, NDP, sucrose, a sucrose synthase, and at least one engineered glycosyltransferase provided herein, combining the stevioside substrate, NDP, sucrose, sucrose synthase, and glycosyltransferase under conditions such that rebaudioside M is produced.

The present invention also provides methods of producing rebaudioside M, comprising providing a stevioside substrate, NDP, sucrose, at least one sucrose synthase, and at least one engineered glycosyltransferase of provided herein, combining the stevioside substrate, NDP, and glycosyltransferase under conditions such that rebaudioside A is first produced, rebaudioside D and/or rebaudioside I is then produced, and rebaudioside M finally produced.

In some embodiments of the methods provided herein, the sucrose synthase is an engineered sucrose synthase provided herein. In some further embodiments of the methods provided herein, the method is conducted as a one-pot reaction. In some alternative embodiments, the method is conducted sequentially. In yet some additional embodiments, the method further comprises repeating the steps of the methods. In some further embodiments, sucrose is recycled during repeated steps. In some additional embodiments, the engineered glycosyltransferase and/or other reaction components are recycled. In yet some further embodiments, the stevioside substrate is extracted from *Stevia rebaudiana*. In some additional embodiments, the stevioside substrate is synthetically produced. In yet some further embodiments, the glycosyltransferase and/or the sucrose synthase is immobilized. In some further embodiments, the method produces a reaction product that includes fructose. In yet some further embodiments, fructose is removed from the reaction product. In some embodiments, the method further comprises a washing step. In some additional embodiments, the method further comprises at least one column chromatography step. In yet some additional embodiments of the methods, at least one engineered glycosyltransferase is a beta-1,2 glycosyltransferase selected from the glycosyltransferase provided herein. In some additional embodiments of the methods, at least one engineered glycosyltransferase is a beta-1,3 glycosyltransferase selected from the glycosyltransferase provided herein. In some embodiments of the methods, at least one engineered glycosyltransferase is a beta-1,2 glycosyltransferase selected from the glycosyltransferases provided herein, and further comprising at least one engineered glycosyltransferase is a beta-1,3 glycosyltransferase selected from the glycosyltransferases provided herein. In some embodiments, the methods further comprise at least one engineered sucrose synthase provided herein.

The present invention also provides at least one rebaudioside produced according to the methods provided herein. The present invention also provides compositions comprising the rebaudioside produced according to the methods provided herein. In some embodiments, rebaudioside M is produced according to the methods provided herein. The present invention also provides compositions comprising rebaudioside M produced according to the methods provided herein.

In some embodiments, rebaudioside A is produced according to the methods provided herein. The present invention also provides compositions comprising rebaudioside A produced according to the methods provided herein. In some embodiments, rebaudioside I is produced according to the methods provided herein. The present invention also provides compositions comprising rebaudioside I produced according to the methods provided herein. In some embodiments, rebaudioside D is produced according to the methods provided herein. The present invention also provides compositions comprising rebaudioside D produced according to the methods provided herein. In some embodiments, a mixture of rebaudiosides is produced according to the methods provided herein. The present invention also provides compositions comprising mixtures of rebaudiosides produced according to the methods provided herein. In some embodiments, the mixtures comprise at least two compositions comprising at least one rebaudioside produced according to the methods provided herein. The present invention provides compositions comprising mixtures of at least two rebaudiosides provided herein.

DESCRIPTION OF THE INVENTION

Figure 1:
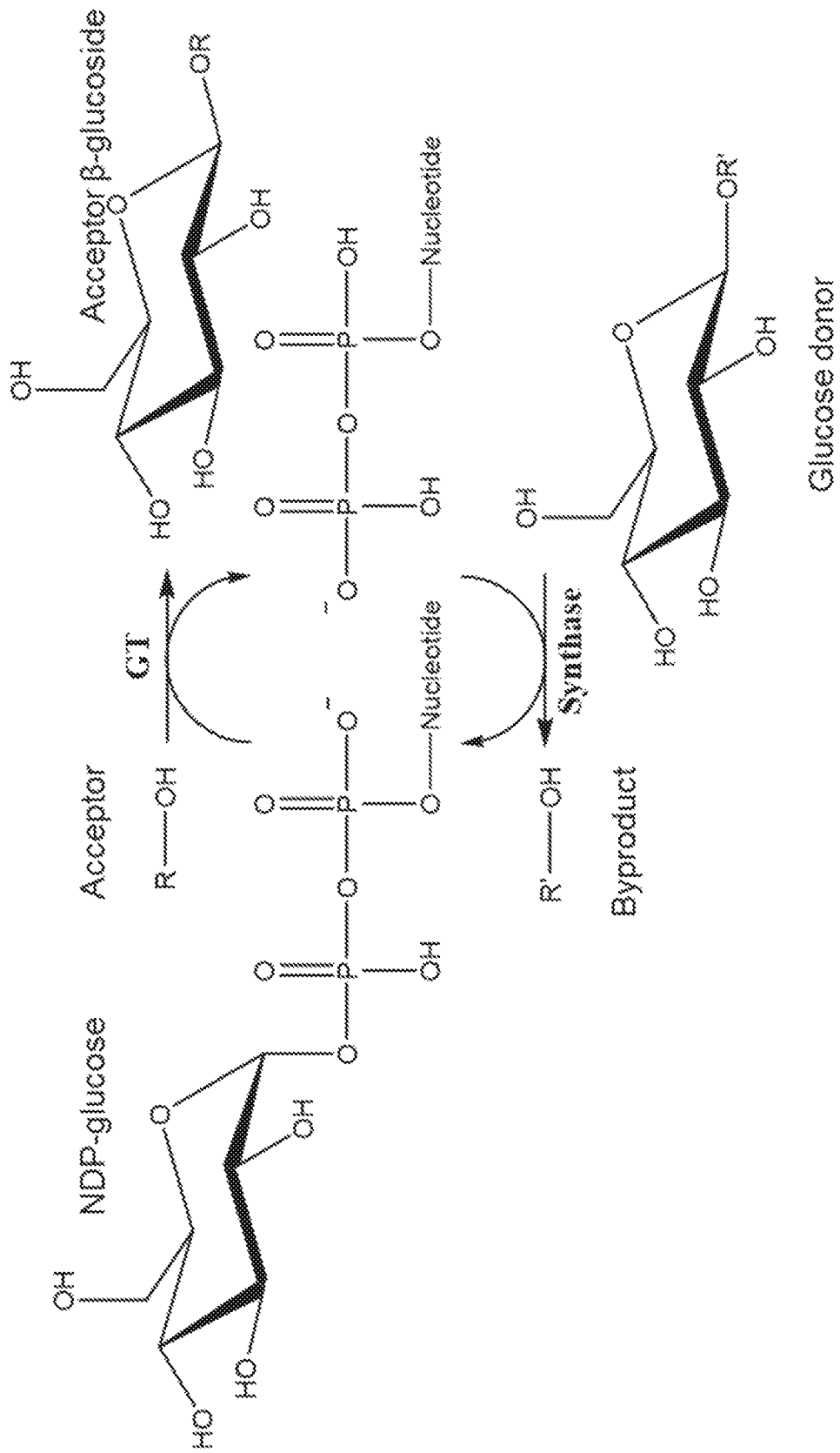
FIG. 1 provides an enzymatic reaction scheme in which a glycosyltransferase catalyzes the transfer of a glucosyl group from a nucleoside diphosphoglucose (NDP-glucose), for example ADP-glucose, to an acceptor, for example R—OH, where R is any glycosyl, alkoxy, carboxy, aminocarbonyl, heteroalkyl, heteroalkenyl, heteroalkynyl, carboxyalkyl, aminoalkyl, haloalkyl, alkylthioalkyl, heterocycloalkyl, heteroaryl, or heteroarylalkyl group. In a further embodiment, R—OH is a stevioside or rebaudioside D, and the product is rebaudioside A, rebaudioside I, or rebaudioside M. A nucleoside diphosphate dependent synthase catalyzes the transfer of a glucosyl group from a glucose donor (e.g., sucrose), to a nucleoside diphosphate, regenerating NDP-glucose and releasing a byproduct (e.g., fructose).
Figure 2:
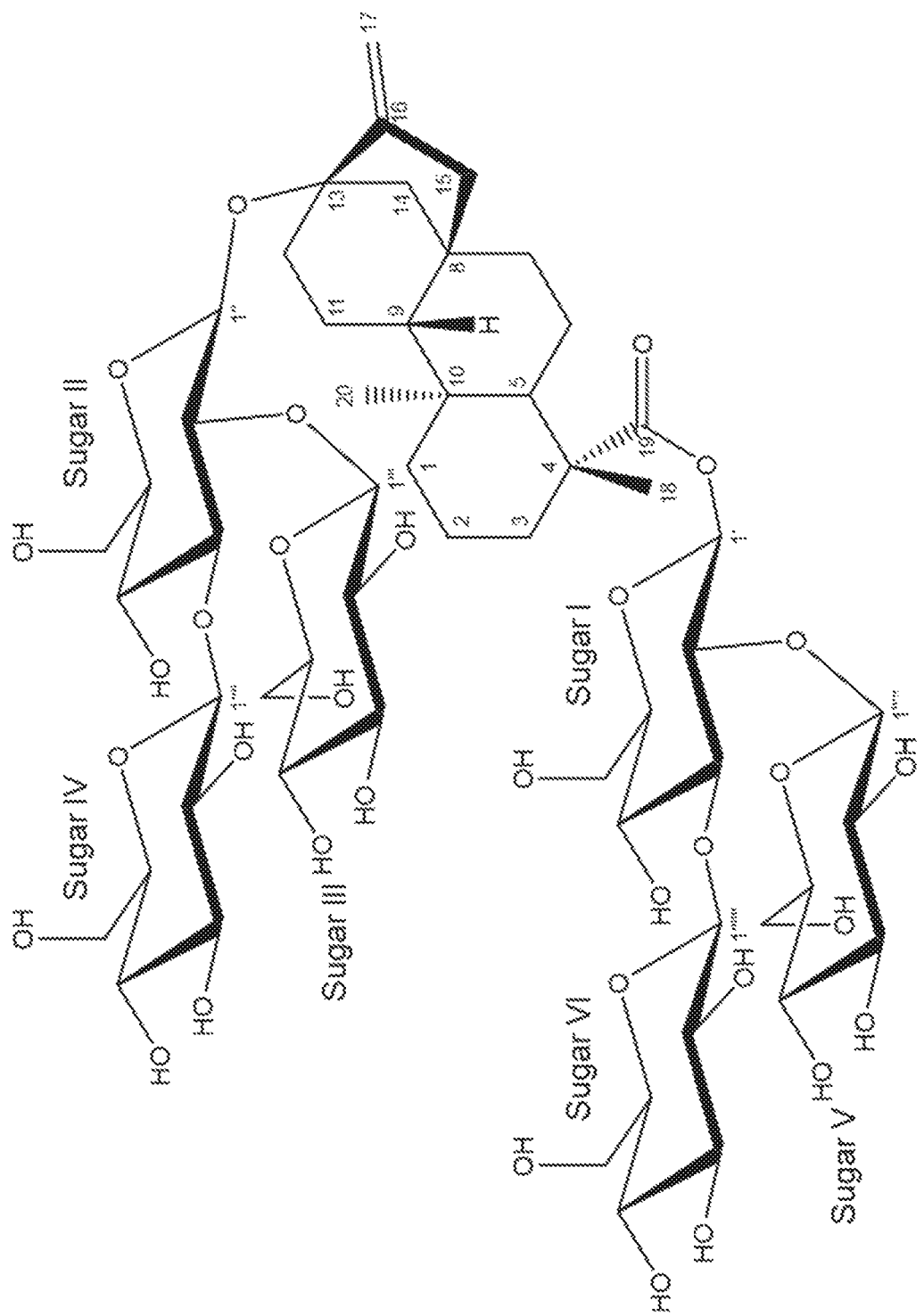
FIG. 2 provides the structure of rebaudioside M with the carbons numbered.
Figure 3:
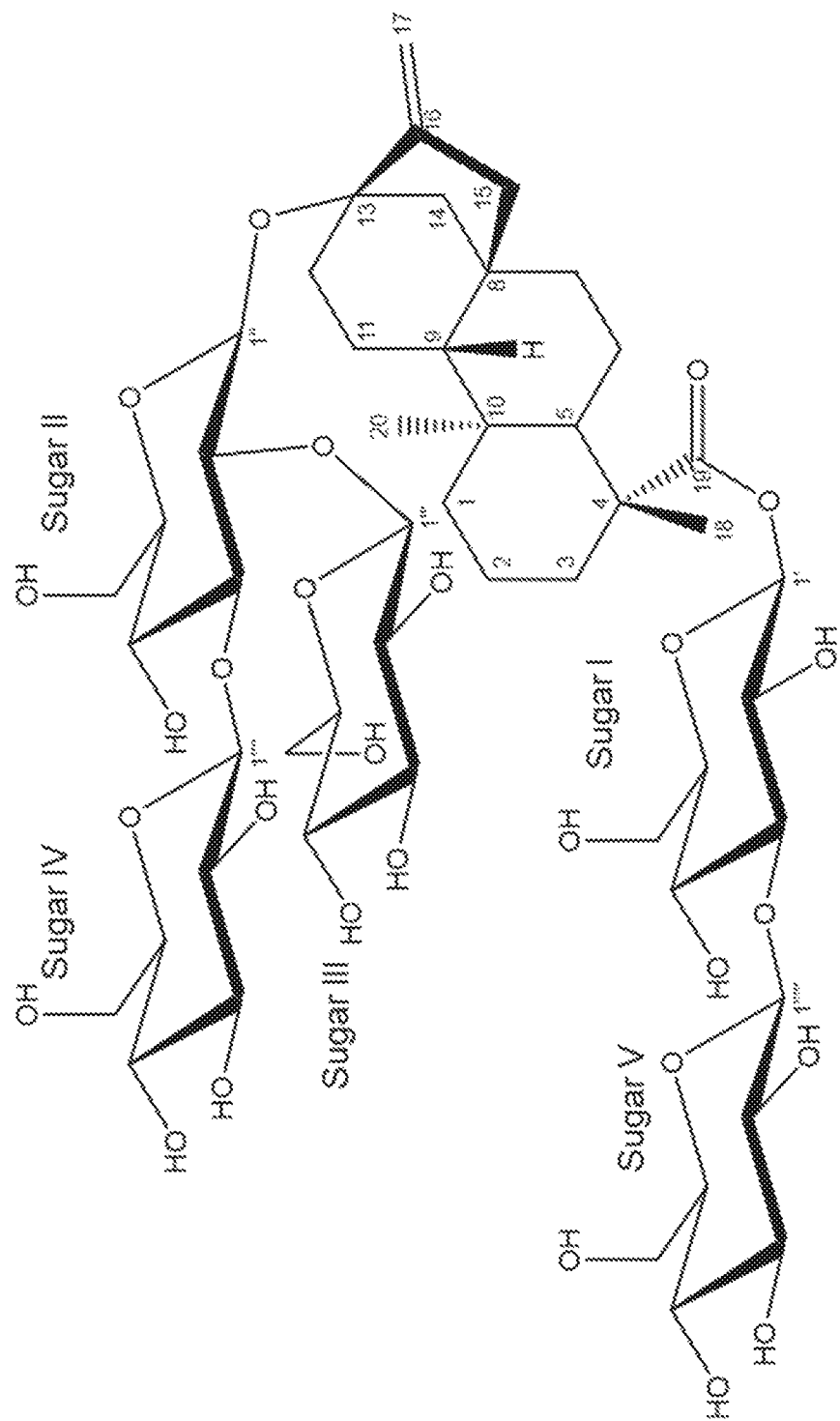
FIG. 3 provides the structure of rebaudioside I with the carbons numbered.

The present invention provides engineered glycosyltransferase (GT) enzymes, polypeptides having GT activity, and polynucleotides encoding these enzymes, as well as vectors and host cells comprising these polynucleotides and polypeptides. The present invention provides engineered sucrose synthase (SuS) enzymes, polypeptides having SuS activity, and polynucleotides encoding these enzymes, as well as vectors and host cells comprising these polynucleotides and polypeptides. The present invention also provides compositions comprising the GT enzymes and methods of using the engineered GT enzymes to make products with β-glucose linkages. The present invention further provides compositions and methods for the production of rebaudiosides (e.g., rebaudioside M, rebaudioside A, rebaudioside I, and rebaudioside D). The present invention also provides compositions comprising the SuS enzymes and methods of using them. Methods for producing GT and SuS enzymes are also provided.

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the invention as a whole.

It is to be understood that both the foregoing general description and the following detailed description are exemplary and explanatory only and are not restrictive of the present invention. The section headings used herein are for organizational purposes only and not to be construed as limiting the subject matter described. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

Abbreviations and Definitions

The abbreviations used for the genetically encoded amino acids are conventional and are as follows: alanine (Ala or A), arginine (Are or R), asparagine (Asn or N), aspartate (Asp or D), cysteine (Cys or C), glutamate (Glu or E), glutamine (Gln or Q), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V). When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

In reference to the present invention, the technical and scientific terms used in the descriptions herein will have the meanings commonly understood by one of ordinary skill in the art, unless specifically defined otherwise. Accordingly, the following terms are intended to have the following meanings.

As used herein, the singular forms "a", "an" and "the" include plural referents unless the context clearly indicates otherwise. Thus, for example, reference to "a polypeptide" includes more than one polypeptide.

Similarly, "comprise," "comprises," "comprising" "include," "includes," and "including" are interchangeable and not intended to be limiting. Thus, as used herein, the term "comprising" and its cognates are used in their inclusive sense (i.e., equivalent to the term "including" and its corresponding cognates).

It is to be further understood that where descriptions of various embodiments use the term "comprising," those skilled in the art would understand that in some specific instances, an embodiment can be alternatively described using language "consisting essentially of" or "consisting of."

As used herein, the term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

As used herein, "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein, "ATCC" refers to the American Type Culture Collection whose biorepository collection includes genes and strains.

As used herein, "NCBI" refers to National Center for Biological Information and the sequence databases provided therein.

"Protein," "polypeptide," and "peptide" are used interchangeably herein to denote a polymer of at least two amino acids covalently linked by an amide bond, regardless of length or post-translational modification (e.g., glycosylation or phosphorylation). Included within this definition are D- and L-amino acids, and mixtures of D- and L-amino acids, as well as polymers comprising D- and L-amino acids, and mixtures of D- and L-amino acids.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "polynucleotide" and "nucleic acid" refer to two or more nucleotides that are covalently linked together. The polynucleotide may be wholly comprised of ribonucleotides (i.e., RNA), wholly comprised of 2' deoxyribonucleotides (i.e., DNA), or comprised of mixtures of ribo- and 2' deoxyribonucleotides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. In some embodiments, such modified or synthetic nucleobases are nucleobases encoding amino acid sequences.

As used herein, "nucleoside" refers to glycosylamines comprising a nucleobase (i.e., a nitrogenous base), and a 5-carbon sugar (e.g., ribose or deoxyribose). Non-limiting examples of nucleosides include cytidine, uridine, adenosine, guanosine, thymidine, and inosine. In contrast, the term "nucleotide" refers to the glycosylamines comprising a nucleobase, a 5-carbon sugar, and one or more phosphate groups. In some embodiments, nucleosides can be phosphorylated by kinases to produce nucleotides.

As used herein, "nucleoside diphosphate" refers to glycosylamines comprising a nucleobase (i.e., a nitrogenous base), a 5-carbon sugar (e.g., ribose or deoxyribose), and a diphosphate (i.e., pyrophosphate) moiety. In some embodiments herein, "nucleoside diphosphate" is abbreviated as "NDP." Non-limiting examples of nucleoside diphosphates include cytidine diphosphate (CDP), uridine diphosphate (UDP), adenosine diphosphate (ADP), guanosine diphosphate (GDP), thymidine diphosphate (TDP), and inosine diphosphate. The terms "nucleoside" and "nucleotide" may be used interchangeably in some contexts.

As used herein, "coding sequence" refers to that portion of a nucleic acid (e.g., a gene) that encodes an amino acid sequence of a protein.

As used herein, the terms "biocatalysis," "biocatalytic," "biotransformation," and "biosynthesis" refer to the use of enzymes to perform chemical reactions on organic compounds.

As used herein, "glycosyltransferase" (GT) refers to a polypeptide having an enzymatic capability of transferring glycosyl residues from an activated sugar donor to monomeric and polymeric acceptor molecules. In some embodiments, the glycosyltransferases are referred to as "glycosyltransferase variants" or "glycosyltransferase combinatorial variants." In some embodiments, "glycosyltransferase" refers to an UDP-glucuronosyltransferase enzyme of the classification EC 2.4.1.17, which catalyzes the transfer of glucose from UDP-α-D-glucuronate (also known as UDP-glucose) to an acceptor, releasing UDP and forming acceptor β-D-glucuronoside. The Carbohydrate-Active Enzymes database (CAZy) provides a continuously updated list of the glycosyltransferase families. In some embodiments, the glycosyltransferases include, but are not limited to, enzymes classified in the GT1 family. In some preferred embodiments, the glycosyltransferase variants of the present invention preferentially utilize ADP-glucose. In some additional embodiments, the glycosyltransferase enzymes of the present invention do not utilize UDP-glucose. In some further embodiments, the glycosyltransferase variants of the present invention utilize ADP-glucose, CDP-glucose, TDP-glucose, GDP-glucose, and/or IDT-glucose, but not UDP-glucose. Thus, in some preferred embodiments, the present invention provides ADP-glucose-dependent glycosyltransferases (ADP-glycosyltransferases; AGTs), CDP-glucose-dependent glycosyltransferases (CDP-glycosyltransferases; CGTs), GDP-glucose-dependent glycosyltransferases (GDP-glycosyltransferases; GGTs), TDP-glucose-dependent glycosyltransferases (TDP-glycosyltransferases; TGTs), and IDP-glucose-dependent glycosyltransferase (IDP-glycosyltransferases; IGTs).

As used herein, "NDP-glycosyltransferase" (NDP-GT) refers to a polypeptide having an enzymatic capability of transferring glycosyl residues from an activated sugar donor that is an NDP to monomeric and polymeric acceptor molecules. In some embodiments, NDP-glycosyltransferases are generally referred to as "glycosyltransferases." Indeed, the term "glycosyltransferase" as used herein encompasses NDP-glycosyltransferases, including, but not limited to ADP-glucose-dependent glycosyltransferases (ADP-glycosyltransferases; AGTs), CDP-glucose-dependent glycosyltransferases (CDP-glycosyltransferases; CGTs), GDP-glucose-dependent glycosyltransferase (GDP-glycosyltransferases; GGTs), TDP-glucose-dependent glycosyltransferases (TDP-glycosyltransferases; TGTs), and IDP-glucose-dependent glycosyltransferase (IDP-glycosyltransferases; IGTs). In some embodiments, the glycosyltransferase enzymes of the present invention utilize ADP-glucose, CDP-glucose, TDP-glucose, GDP-glucose, and/or IDT-glucose, but not UDP-glucose. In some additional embodiments the enzymes are referred to as "variants" or "combinatorial variants" (e.g., ADP-glycosyltransferase variants).

As used herein, "transglycosylation" refers to a reaction in which a glycosyl residue is transferred from a disaccharide, trisaccharide, or oligosaccharide donor to an aglycosylated or glycosylated acceptor molecule.

As used herein, "transglucosylation" refers to a transglycosylation reaction in which the glycosyl residue that is transferred is a glucose and the disaccharide, trisaccharide, or oligosaccharide donor contains glucose.

As used herein, "glycosylation" refers to the formation of a glycosidic linkage between a glycosyl residue and an acceptor molecule.

As used herein, "glucosylation" refers to the formation of a glycosidic linkage between a glucose residue and an acceptor molecule.

As used herein, "glycosyl" refers to an organic group that is a univalent free radical or substituent structure obtained by removing the hemiacetal hydroxyl group from the cyclic form of a monosaccharide, lower oligosaccharide or oligosaccharide derivative. Glycosyl groups react with inorganic acids (e.g., phosphoric acid) to form esters (e.g., glucose 1-phosphate).

As used herein, "glycoside" refers to a molecule in which a carbohydrate (e.g., sugar) is bound to another functional group by a glycosidic bond. Glycosides can be hydrolyzed to produce a sugar and a non-sugar (i.e., aglycone) component.

As used herein, the term "steviol glycoside" refers to a glycoside of steviol, including but not limited to, naturally occurring steviol glycosides (e.g., stevioside, steviolmonoside, steviolbioside, rubusoside, dulcoside B, dulcoside A, rebaudioside B, rebaudioside G, rebaudioside C, rebaudioside F, rebaudioside A, rebaudioside I, rebaudioside E, rebaudioside H, rebaudioside L, rebaudioside K, rebaudioside J, rebaudioside M (also referred to as rebaudioside X), rebaudioside D, rebaudioside N, rebaudioside O), and synthetic steviol glycosides (e.g., enzymatically glucosylated steviol glycosides), and combinations thereof. The chemical structures of steviol and its glycosides are below (See, WO 2013/176738).

As used herein, "stevioside substrate" refers to any suitable material comprising at least one steviol glycoside.

production of rebM from a starting material, including but not limited to as rebA and/or steviosides with the intermediate production of other rebaudiosides (e.g., rebD and/or rebI). In some embodiments, the conversion of stevioside to RebA, RebA to RebD and/or RebI and RebD and/or RebI to Reb M, are conducted as a multiple enzyme cascade in one reaction vessel.

As used herein, "wild-type" and "naturally-occurring" refer to the form found in nature. For example a wild-type polypeptide or polynucleotide sequence is a sequence present in an organism that can be isolated from a source in nature and which has not been intentionally modified by human manipulation.

As used herein, "recombinant," "engineered," and "non-naturally occurring" when used with reference to a cell, nucleic acid, or polypeptide, refers to a material, or a material corresponding to the natural or native form of the material, that has been modified in a manner that would not otherwise exist in nature. In some embodiments, the cell, nucleic acid or polypeptide is identical a naturally occurring Chemical Structure of Steviol and Its Glycosides

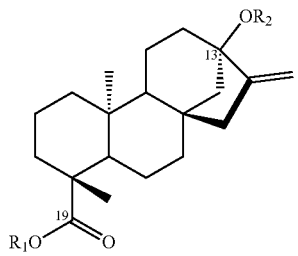

| Glycoside | $R_1$ | $R_2$ |
|---|---|---|
| Steviol | H | H |
| Steviolmonoside | H | Glcβ1- |
| Steviol monoglucosyl ester | Glcβ1- | H |
| Rubusoside | Glcβ1- | Glcβ1- |
| Steviolbioside | H | Glcβ (1-2) Glcβ1- |
| Dulcoside A | Glcβ1- | Rhaα(1-2) Glcβ1- |
| Stevioside | Glcβ1- | Glcβ (1-2) Glcβ1- |
| Rebaudioside B | H | Glcβ (1-2)[Glcβ (1-3)] Glcβ1- |
| Rebaudioside C | Glcβ1- | Rhaα(1-2)[Glcβ (1-3)] Glcβ1- |
| Rebaudioside A | Glcβ1- | Glcβ (1-2)[Glcβ (1-3)] Glcβ1- |
| Rebaudioside D | Glcβ (1-2) Glcβ1- | Glcβ (1-2)[Glcβ (1-3)] Glcβ1- |
| Rebaudioside I | Glcβ (1-3) Glcβ1- | Glcβ (1-2)[Glcβ (1-3)] Glcβ1- |
| Rebaudioside M | Glcβ (1-2)[Glcβ (1-3)] Glcβ1- | Glcβ (1-2)[Glcβ (1-3)] Glcβ1- |

(Glc = glucose, Rha = rhamnose)

As used herein, "sucrose synthase" refers to a glycosyltransferase enzyme (EC 2.4.1.1.13) that reversibly catalyzes the chemical reaction NDP-glucose+D-fructose to NDP and sucrose. In some embodiments, the present invention provides variants of *Acidithiobacillus caldus* sucrose synthase ("AcSuS"). In some embodiments, these enzymes are referred to as "sucrose synthase variants," "SuS," "SUS," "SuS variants," "SUS variants," "sucrose synthase combinatorial variants," or "SuS combinatorial variants," or "SUS combinatorial variants." In some embodiments, these variants preferentially utilize NDPs other than uridine (i.e., ADP-glucose, CDP-glucose, TDP-glucose, GDP-glucose, and/or IDP-glucose are utilized, rather than UDP-glucose). In some embodiments, these variants do not utilize UDP-glucose.

As used herein, the term "one-pot reaction" refers to the production of rebaudioside of interest in one reaction vessel. In some embodiments, the term is used in reference to the cell, nucleic acid or polypeptide, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

The term "percent (%) sequence identity" is used herein to refer to comparisons among polynucleotides or polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted by any suitable method, including, but not limited to the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See Altschul et al., J. Mol. Biol., 215: 403-410 [1990]; and Altschul et al., Nucl. Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison Wis.), using default parameters provided.

As used herein, "reference sequence" refers to a defined sequence used as a basis for a sequence and/or activity comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptides are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

As used herein, "comparison window" refers to a conceptual segment of at least about 20 contiguous nucleotide positions or amino acid residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "corresponding to," "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered glycosyltransferase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

As used herein, "substantial identity" refers to a polynucleotide or polypeptide sequence that has at least 80 percent sequence identity, at least 85 percent identity, at least between 89 to 95 percent sequence identity, or more usually, at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In some specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some embodiments, residue positions that are not identical in sequences being compared differ by conservative amino acid substitutions.

As used herein, "amino acid difference" and "residue difference" refer to a difference in the amino acid residue at a position of a polypeptide sequence relative to the amino acid residue at a corresponding position in a reference sequence. In some cases, the reference sequence has a histidine tag, but the numbering is maintained relative to the equivalent reference sequence without the histidine tag. The positions of amino acid differences generally are referred to herein as "Xn," where n refers to the corresponding position in the reference sequence upon which the residue difference is based. For example, a "residue difference at position X93 as compared to SEQ ID NO:4" refers to a difference of the amino acid residue at the polypeptide position corresponding to position 93 of SEQ ID NO:4. Thus, if the reference polypeptide of SEQ ID NO:4 has a serine at position 93, then a "residue difference at position X93 as compared to SEQ ID NO:4" an amino acid substitution of any residue other than serine at the position of the polypeptide corresponding to position 93 of SEQ ID NO:4. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in the Tables presented in the Examples), the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present invention can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X307H/X307P or X307H/P). The slash may also be used to indicate multiple substitutions within a given variant (i.e., there is more than one substitution present in a given sequence, such as in a combinatorial variant). In some embodiments, the present invention includes engineered polypeptide sequences comprising one or more amino acid differences comprising conservative or non-conservative amino acid substitutions. In some additional embodiments, the present invention provides engineered polypeptide sequences comprising both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with an hydroxyl side chain is substituted with another amino acid with an hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered glycosyltransferase enzyme. Deletions can be directed to the internal portions and/or terminal portions of the polypeptide. In various embodiments, the deletion can comprise a continuous segment or can be discontinuous. Deletions are typically indicated by "-" in amino acid sequences.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

A "functional fragment" and "biologically active fragment" are used interchangeably herein to refer to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered glycosyltransferase of the present invention) and that retains substantially all of the activity of the full-length polypeptide.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., within a host cell or via in vitro synthesis). The recombinant glycosyltransferase polypeptides may be present within a cell, present in the cellular medium, or prepared in various forms, such as lysates or isolated preparations. As such, in some embodiments, the recombinant glycosyltransferase polypeptides can be an isolated polypeptide.

As used herein, "substantially pure polypeptide" or "purified protein" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. However, in some embodiments, the composition comprising glycosyltransferase comprises glycosyltransferase that is less than 50% pure (e.g., about 10%, about 20%, about 30%, about 40%, or about 50%) Generally, a substantially pure glycosyltransferase composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant glycosyltransferase polypeptides are substantially pure polypeptide compositions.

As used herein, "improved enzyme property" refers to at least one improved property of an enzyme. In some embodiments, the present invention provides engineered glycosyltransferase polypeptides that exhibit an improvement in any enzyme property as compared to a reference glycosyltransferase polypeptide and/or a wild-type glycosyltransferase polypeptide, and/or another engineered glycosyltransferase polypeptide. Thus, the level of "improvement" can be determined and compared between various glycosyltransferase polypeptides, including wild-type, as well as engineered glycosyltransferases. Improved properties include, but are not limited, to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic pH, increased tolerance to proteolytic activity (i.e., reduced sensitivity to proteolysis), reduced aggregation, increased solubility, and altered temperature profile. In additional embodiments, the term is used in reference to the at least one improved property of sucrose synthase enzymes. In some embodiments, the present invention provides engineered sucrose synthase polypeptides that exhibit an improvement in any enzyme property as compared to a reference sucrose synthase polypeptide and/or a wild-type sucrose synthase polypeptide, and/or another engineered sucrose synthase polypeptide. Thus, the level of "improvement" can be determined and compared between various sucrose synthase polypeptides, including wild-type, as well as engineered sucrose synthases.

As used herein, "increased enzymatic activity" and "enhanced catalytic activity" refer to an improved property of the engineered polypeptides, which can be represented by an increase in specific activity (e.g., product produced/time/weight protein) or an increase in percent conversion of the substrate to the product (e.g., percent conversion of starting amount of substrate to product in a specified time period using a specified amount of enzyme) as compared to the reference enzyme. In some embodiments, the terms refer to an improved property of engineered glycosyltransferase polypeptides provided herein, which can be represented by an increase in specific activity (e.g., product produced/time/weight protein) or an increase in percent conversion of the substrate to the product (e.g., percent conversion of starting amount of substrate to product in a specified time period using a specified amount of glycosyltransferase) as compared to the reference glycosyltransferase enzyme. In some embodiments, the terms are used in reference to improved sucrose synthase enzymes provided herein. Exemplary methods to determine enzyme activity of the engineered glycosyltransferases and sucrose synthases of the present invention are provided in the Examples. Any property relating to enzyme activity may be affected, including the classical enzyme properties of $K_m$, $V_{max}$ or $k_{cat}$, changes of which can lead to increased enzymatic activity. For example, improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring glycosyltransferase or another engineered glycosyltransferase from which the glycosyltransferase polypeptides were derived.

As used herein, "conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a glycosyltransferase polypeptide can be expressed as "percent conversion" of the substrate to the product in a specific period of time.

Enzymes with "generalist properties" (or "generalist enzymes") refer to enzymes that exhibit improved activity for a wide range of substrates, as compared to a parental sequence. Generalist enzymes do not necessarily demonstrate improved activity for every possible substrate. In some embodiments, the present invention provides glycosyltransferase variants with generalist properties, in that they demonstrate similar or improved activity relative to the parental gene for a wide range of sterically and electronically diverse substrates. In addition, the generalist enzymes provided herein were engineered to be improved across a wide range of diverse molecules to increase the production of metabolites/products.

The term "stringent hybridization conditions" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (See e.g., Baldino et al., Meth. Enzymol., 168:761-777 [1989]; Bolton et al., Proc. Natl. Acad. Sci. USA 48:1390 [1962]; Bresslauer et al., Proc. Natl. Acad. Sci. USA 83:8893-8897 [1986]; Freier et al., Proc. Natl. Acad. Sci. USA 83:9373-9377 [1986]; Kierzek et al., Biochem., 25:7840-7846 [1986]; Rychlik et al., Nucl. Acids Res., 18:6409-6412 [1990] (erratum, Nucl. Acids Res., 19:698 [1991]); Sambrook et al., supra); Suggs et al., 1981, in *Developmental Biology Using Purified Genes*, Brown et al. [eds.], pp. 683-693, Academic Press, Cambridge, Mass. [1981]; and Wetmur, Crit. Rev. Biochem. Mol. Biol. 26:227-259 [1991]). In some embodiments, the polynucleotide encodes the polypeptide disclosed herein and hybridizes under defined conditions, such as moderately stringent or highly stringent conditions, to the complement of a sequence encoding an engineered glycosyltransferase enzyme of the present invention.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w/v) SDS at 65° C. and washing in 0.1×SSC containing 0.1% SDS at 65° C. Other high stringency hybridization conditions, as well as moderately stringent conditions, are described in the references cited above.

As used herein, "codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the glycosyltransferase enzymes may be codon optimized for optimal production in the host organism selected for expression.

As used herein, "preferred," "optimal," and "high codon usage bias" codons when used alone or in combination refer(s) interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, Peden, University of Nottingham; McInerney, Bioinform., 14:372-73 [1998]; Stenico et al., Nucl. Acids Res., 222437-46 [1994]; and Wright, Gene 87:23-29 [1990]). Codon usage tables are available for many different organisms (See e.g., Wada et al., Nucl. Acids Res., 20:2111-2118 [1992]; Nakamura et al., Nucl. Acids Res., 28:292 [2000]; Duret, et al., supra; Henaut and Danchin, in *Escherichia coli and Salmonella*, Neidhardt, et al. (eds.), ASM Press, Washington D.C., p. 2047-2066 [1996]). The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Mount, *Bioinformatics: Sequence and Genome Analysis*, Chapter 8, Cold Spring Harbor Laboratory Press, Cold Spring Harbor, N.Y. [2001]; Uberbacher, Meth. Enzymol., 266:259-281 [1996]; and Tiwari et al., Comput. Appl. Biosci., 13:263-270 [1997]).

As used herein, "control sequence" includes all components, which are necessary or advantageous for the expression of a polynucleotide and/or polypeptide of the present invention. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

The phrase "suitable reaction conditions" refers to those conditions in the enzymatic conversion reaction solution (e.g., ranges of enzyme loading, substrate loading, temperature, pH, buffers, co-solvents, etc.) under which a glycosyltransferase polypeptide of the present invention is capable of converting a substrate to the desired product compound. Some exemplary "suitable reaction conditions" are provided herein.

As used herein, "loading," such as in "compound loading" or "enzyme loading" refers to the concentration or amount of a component in a reaction mixture at the start of the reaction.

As used herein, "substrate" in the context of an enzymatic conversion reaction process refers to the compound or molecule acted on by the engineered enzymes provided herein (e.g., engineered glycosyltransferase polypeptides).

As used herein, the terms "biomass," "biomass substrate," "cellulosic biomass," "cellulosic feedstock," and "cellulosic substrate" refer to any materials that contain cellulose. Biomass can be derived from plants, animals, or microorganisms, and may include, but is not limited to agricultural, industrial, and forestry residues, industrial and municipal wastes, and terrestrial and aquatic crops grown for energy purposes. Examples of cellulosic substrates include, but are not limited to, wood, wood pulp, paper pulp, corn fiber, corn grain, corn cobs, crop residues such as corn husks, corn stover, grasses, wheat, wheat straw, barley, barley straw, hay, rice, rice straw, switchgrass, waste paper, paper and pulp processing waste, woody or herbaceous plants, fruit or vegetable pulp, corn cobs, distillers grain, grasses, rice hulls, cotton, hemp, flax, sisal, sugar cane bagasse, sorghum, soy, switchgrass, components obtained from milling of grains, trees, branches, roots, leaves, wood chips, sawdust, shrubs and bushes, vegetables, fruits, and flowers and any suitable mixtures thereof. In some embodiments, the cellulosic biomass comprises, but is not limited to cultivated crops (e.g., grasses, including C4 grasses, such as switch grass, cord grass, rye grass, *miscanthus*, reed canary grass, or any combination thereof), sugar processing residues, for example, but not limited to, bagasse (e.g., sugar cane bagasse, beet pulp [e.g., sugar beet], or a combination thereof), agricultural residues (e.g., soybean stover, corn stover, corn fiber, rice straw, sugar cane straw, rice, rice hulls, barley straw, corn cobs, wheat straw, canola straw, oat straw, oat hulls, corn fiber, hemp, flax, sisal, cotton, or any combination thereof), fruit pulp, vegetable pulp, distillers' grains, forestry biomass (e.g., wood, wood pulp, paper pulp, recycled wood pulp fiber, sawdust, hardwood, such as aspen wood, softwood, or a combination thereof). Furthermore, in some embodiments, the cellulosic biomass comprises cellulosic waste material and/or forestry waste materials, including but not limited to, paper and pulp processing waste, newsprint, cardboard and the like. In some embodiments, the cellulosic biomass comprises one species of fiber, while in some alternative embodiments, the cellulosic biomass comprises a mixture of fibers that originate from different cellulosic biomasses. In some embodiments, the biomass may also comprise transgenic plants that express ligninase and/or cellulase enzymes (See e.g., US 2008/0104724, incorporated by reference herein).

As used herein, the term "slurry" refers to an aqueous solution in which are dispersed one or more solid components, such as a cellulosic substrate.

As used herein, "increasing" yield of a product (e.g., a steviol glycoside) from a reaction occurs when a particular component present during the reaction (e.g., a GH enzyme) causes more product to be produced, compared with a reaction conducted under the same conditions with the same substrate and other substituents, but in the absence of the component of interest.

As used herein, "hydrolyzing" cellulose or other polysaccharide occurs when at least some of the glycosidic bonds between two monosaccharides present in the substrate are hydrolyzed, thereby detaching from each other the two monomers that were previously bonded.

A reaction is the to be "substantially free" of a particular enzyme if the amount of that enzyme compared with other enzymes that participate in catalyzing the reaction is less than about 2%, about 1%, or about 0.1% (wt/wt).

As used herein, "fractionating" a liquid (e.g., a culture broth) means applying a separation process (e.g., salt precipitation, column chromatography, size exclusion, and filtration) or a combination of such processes to provide a solution in which a desired protein (e.g., rebaudiosides) comprises a greater percentage of total protein in the solution than in the initial liquid product.

As used herein, "starting composition" refers to any composition that comprises at least one substrate. In some embodiments, the starting composition comprises any cellulosic substrate.

In some alternative embodiments, the term "starting composition" refers to any composition comprising at least one steviol glycoside, wherein one or more of the steviol glycosides act as substrate(s) for a biotransformation. In some embodiments, the starting composition is provided as an aqueous solution. In some embodiments, the starting composition comprises at least one steviol glycoside selected from stevioside, steviolmonoside, steviolbioside, rubusoside, dulcoside B, dulcoside A, rebaudioside B, rebaudioside G, rebaudioside C, rebaudioside F, rebaudioside A, rebaudioside I, rebaudioside E, rebaudioside H, rebaudioside L, rebaudioside K, rebaudioside J, rebaudioside M (also referred to as rebaudioside X), rebaudioside D, rebaudioside N, rebaudioside O, and synthetic steviol glycosides (e.g., enzymatically glucosylated steviol glycosides), In some embodiments, the starting composition comprises two or more steviol glycosides. In some embodiments, the starting composition comprises an extract obtained from purification of *Stevia rebaudiana* plant material (e.g., leaves). In some alternative embodiments, the starting composition comprises commercially available *stevia* extract(s). Additional starting compositions comprise by-products of processes used to isolate and purify steviol glycosides. In some embodiments, the starting composition comprises purified or partially purified steviol glycoside substrate(s). In some embodiments, the starting composition comprises greater than about 99% of a particular steviol glycoside by weight.

In some embodiments, the starting composition comprises at least one glycoside and a cellulosic component as the substrate to produce at least one steviol glycoside (e.g., rebaudioside A, D, etc.).

As used herein, "product" in the context of an enzymatic conversion process refers to the compound or molecule resulting from the action of an enzymatic polypeptide on a substrate. As used herein, in some embodiments, the term refers to the compound or molecule resulting from the action of the glycosyltransferase polypeptide on a substrate. In some embodiments, the product provided by the present invention is a steviol glycoside. In some embodiments, the product comprises at least one steviol glycoside selected from stevioside, steviolmonoside, steviolbioside, rubusoside, dulcoside B, dulcoside A, rebaudioside B, rebaudioside G, rebaudioside C, rebaudioside F, rebaudioside A, rebaudioside I, rebaudioside E, rebaudioside H, rebaudioside L, rebaudioside K, rebaudioside J, rebaudioside M (also referred to as rebaudioside X), rebaudioside D, rebaudioside N, rebaudioside O, and synthetic steviol glycosides (e.g., enzymatically glucosylated steviol glycosides), As used herein the term "culturing" refers to the growing of a population of microbial cells under any suitable conditions (e.g., using a liquid, gel or solid medium).

Recombinant polypeptides can be produced using any suitable methods known in the art. Genes encoding the wild-type polypeptide of interest can be cloned in vectors, such as plasmids, and expressed in desired hosts, such as *E. coli*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Mutagenesis and directed evolution methods can be readily applied to enzyme-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, 9,665,694, 9,684,771, and all related US, as well as PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229: 1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the enzyme clones obtained following mutagenesis treatment are screened by subjecting the enzyme preparations to a defined temperature (or other assay conditions) and measuring the amount of enzyme activity remaining after heat treatments or other suitable assay conditions. Clones containing a polynucleotide encoding a polypeptide are then isolated from the gene, sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

After the variants are produced, they can be screened for any desired property (e.g., high or increased activity, or low or reduced activity, increased thermal activity, increased thermal stability, and/or acidic pH stability, etc.). In some embodiments, "recombinant glycosyltransferase polypeptides" (also referred to herein as "engineered glycosyltransferase polypeptides," "variant glycosyltransferase enzymes," "glycosyltransferase variants," and "glycosyltransferase combinatorial variants") find use. In some embodiments, "recombinant sucrose synthase polypeptides" (also referred to as "engineered sucrose synthase polypeptides," "variant sucrose synthase enzymes," "sucrose synthase variants," and "sucrose synthase combinatorial variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature. For example a "heterologous polynucleotide" is any polynucleotide that is introduced into a host cell by laboratory techniques, and includes polynucleotides that are removed from a host cell, subjected to laboratory manipulation, and then reintroduced into a host cell.

As used herein, the terms "host cell" and "host strain" refer to suitable hosts for expression vectors comprising DNA provided herein (e.g., the polynucleotides encoding the glycosyltransferase variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues means polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

As used herein, "stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess ("e.e.") calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess ("d.e."). Enantiomeric excess and diastereomeric excess are types of stereomeric excess.

As used herein, "regioselectivity" and "regioselective reaction" refer to a reaction in which one direction of bond making or breaking occurs preferentially over all other possible directions. Reactions can completely (100%) regioselective if the discrimination is complete, substantially regioselective (at least 75%), or partially regioselective (x %, wherein the percentage is set dependent upon the reaction of interest), if the product of reaction at one site predominates over the product of reaction at other sites.

As used herein, "thermostable" refers to a glycosyltransferase polypeptide that maintains similar activity (more than 60% to 80% for example) after exposure to elevated temperatures (e.g., 40-80° C.) for a period of time (e.g., 0.5-24 h) compared to the wild-type enzyme exposed to the same elevated temperature.

As used herein, "solvent stable" refers to a glycosyltransferase polypeptide that maintains similar activity (more than e.g., 60% to 80%) after exposure to varying concentrations (e.g., 5-99%) of solvent (ethanol, isopropyl alcohol, dimethylsulfoxide [DMSO], tetrahydrofuran, 2-methyltetrahydrofuran, acetone, toluene, butyl acetate, methyl tert-butyl ether, etc.) for a period of time (e.g., 0.5-24 h) compared to the wild-type enzyme exposed to the same concentration of the same solvent.

As used herein, "thermo- and solvent stable" refers to a glycosyltransferase polypeptide that is both thermostable and solvent stable.

As used herein, "reductant" refers to a compound or agent capable of converting $Fe^{+3}$ to $Fe^{+2}$. An exemplary reductant is ascorbic acid, which is generally in the form of L-ascorbic acid.

As used herein, "optional" and "optionally" mean that the subsequently described event or circumstance may or may not occur, and that the description includes instances where the event or circumstance occurs and instances in which it does not. One of ordinary skill in the art would understand that with respect to any molecule described as containing one or more optional substituents, only sterically practical and/or synthetically feasible compounds are meant to be included. "Optionally substituted" refers to all subsequent modifiers in a term or series of chemical groups.

Glycosylation

Glycosylation can alter many properties of natural and synthetic products including stability, pharmacodynamics, solubility, and membrane transport. The present invention provides compositions, methods and enzymes suitable for generating new glycosylated compounds from various aglycone and glycosylated substrates. In some embodiments, the present invention provides means to efficiently generate known glycosylated compounds from easily obtained precursors. In some cases, glycosylation is achieved through chemical synthesis methods. However, these methods typically require undesirable chemicals and processes and can result in mixed products (e.g., with linkages in incorrect positions and/or with undesired anomeric configurations). Furthermore, carbohydrate chemistry requires multiple protection and deprotection steps.

In contrast, glycosylating enzymes can be active under mild conditions and can confer high positional selectivity and stereospecificity in a single step. Many naturally-occurring glycosylated metabolites are generated in vivo using glycosyltransferases that transfer sugar moieties from various sugar nucleosides. Many molecules, including many secondary metabolites with antimicrobial, antitumor, natural sweetness properties, etc., comprise non-ribosomal peptide, polyketide, or terpenoid backbones modified with β-glycosidic linkages. Many of the diterpene glycosides extracted from the plant, *Stevia rebaudiana* Bertoni, contain β-linked glucose molecules. Naturally, these molecules are glycosylated in vivo using UDP-glucose dependent glycosyl transferase enzymes. The present invention provides a method (See, FIG. 1), in which a new engineered glycosyltransferase is used to transfer the glucose moiety from a nucleoside diphosphoglucose to a substrate (e.g., rebaudioside D or stevioside), to produce one or more β-glucose linked products (e.g., rebaudioside M, rebaudioside A, or rebaudioside I). However, when used in vitro, the UDP-glucose can be prohibitively expensive and/or unavailable. In the some additional embodiments, a synthase (e.g., sucrose synthase or trehalose synthase) acts in the reverse direction to form a nucleoside diphosphoglucose compound from a nucleoside diphosphate and a glucose donor (e.g., sucrose, trehalose, or starch).

Thus, glycosylation finds use in the production of natural sweeteners, such as those derived from the sweet herb, *Stevia rebaudiana* Bertoni. As indicated above, this plant produces a number of diterpene glycosides which feature high intensity sweetness and sensory properties superior to those of many other high potency sweeteners. The above-mentioned sweet glycosides, have a common aglycone (i.e., steviol), and differ by the number and type of carbohydrate residues at the C13 and C19 positions. Steviol glycosides differ from each other not only in their molecular structure, but also by their taste properties. Usually, stevioside is reported to be 89-143 times sweeter than sucrose, while rebaudioside A is reported to be between 85 and 242 times sweeter than sucrose (See e.g., Kasai et al., Nippon Kagaku Kaishi, 1981:726-735 [1981]). Of these common compounds, rebaudioside A has the least astringent, the least bitter, and the least persistent aftertaste. Thus, it has the most favorable sensory attributes of the major steviol glycosides and has been commercialized. However, rebaudioside A only constitutes a smaller fraction (about 20%) of total glycosides isolated from Stevia rebaudiana Bertoni, with stevioside (about 70%) and minor steviol glycosides making up the rest (See e.g., FAO, Chemical and Technical Assessment, $63^{rd}$ JECFA, Steviol Glycosides [2004]). The naturally occurring but even less abundant compound rebaudioside M, also known as rebaudioside X, is 200-350 times sweeter than sucrose and has a reduced aftertaste relative to rebaudioside A (See e.g., Prakash et al., Food, 3:162-175 [2014]). Thus, there is interest in the commercialization of rebaudioside M, for example as a natural sweetener, but currently no viable commercial route to synthesize this compound.

Engineered Glycosyltransferase Polypeptides

The present invention provides glycosyltransferase polypeptides, polynucleotides encoding the polypeptides, methods of preparing the polypeptides, and methods for using the polypeptides. Where the description relates to polypeptides, it is to be understood that it also describes the polynucleotides encoding the polypeptides. In some embodiments, the present invention provides engineered, non-naturally occurring GT enzymes with improved properties as compared to wild-type GT enzymes. Any suitable reaction conditions find use in the present invention. In some embodiments, methods are used to analyze the improved properties of the engineered polypeptides to carry out the transferase reaction. In some embodiments, the reaction conditions are modified with regard to concentrations or amounts of polypeptide, substrate, co-substrate, buffer, co-solvent, pH, conditions including temperature and reaction time, and/or conditions with the polypeptide immobilized on a solid support, as further described below and in the Examples.

In some embodiments, the engineered GT polypeptides described herein have improved properties as compared to wild-type GT enzymes such as in the conversion of steviol glycosides to further glycosylated steviol glycosides (e.g., stevioside to rebaudioside A or rebaudioside D to rebaudioside M) and in the use of adenine diphosphoglucose or other nucleoside diphosphates In some embodiments, additional reaction components or additional techniques are utilized to supplement the reaction conditions. In some embodiments, these include taking measures to stabilize or prevent inactivation of the enzyme, reduce product inhibition, shift reaction equilibrium to glucosylated product formation.

In some further embodiments, any of the above described process for the conversion of substrate compound to product compound can further comprise one or more steps selected from: extraction; isolation; purification; and crystallization, filtration, or lyophilization of product compound. Methods, techniques, and protocols for extracting, isolating, purifying, and/or crystallizing the glucosylated product from biocatalytic reaction mixtures produced by the above disclosed processes are known to the ordinary artisan and/or accessed through routine experimentation. Additionally, illustrative methods are provided in the Examples below.

Engineered Sucrose Synthase Polypeptides

The present invention provides engineered sucrose synthase (SuS) polypeptides, polynucleotides encoding the polypeptides, methods of preparing the polypeptides, and methods for using the polypeptides. Where the description relates to polypeptides, it is to be understood that it also describes the polynucleotides encoding the polypeptides. In some embodiments, the present invention provides engineered, non-naturally occurring SuS enzymes with improved properties as compared to wild-type SuS enzymes. Any suitable reaction conditions find use in the present invention. In some embodiments, methods are used to analyze the improved properties of the engineered polypeptides to carry out the synthase reaction. In some embodiments, the reaction conditions are modified with regard to concentrations or amounts of engineered SuS, substrate(s), buffer(s), solvent(s), pH, conditions including temperature and reaction time, and/or conditions with the engineered SuS polypeptide immobilized on a solid support, as further described below and in the Examples.

In some embodiments, the engineered SuS polypeptides described herein have improved properties as compared to wild-type SuS enzymes such as in the reactions described herein.

In some embodiments, additional reaction components or additional techniques are utilized to supplement the reaction conditions. In some embodiments, these include taking measures to stabilize or prevent inactivation of the enzyme, reduce product inhibition, shift reaction equilibrium to glucosylated product formation.

In some further embodiments, any of the above described process for the conversion of substrate compound to product compound can further comprise one or more steps selected from: extraction, isolation, purification, crystallization, filtration, and/or lyophilization of product compound(s). Methods, techniques, and protocols for extracting, isolating, purifying, and/or crystallizing the product(s) (e.g., rebaudiosides) from biocatalytic reaction mixtures produced by the processes provided herein are known to the ordinary artisan and/or accessed through routine experimentation. Additionally, illustrative methods are provided in the Examples below.

Polynucleotides Encoding Engineered Polypeptides, Expression Vectors and Host Cells The present invention provides polynucleotides encoding the engineered enzyme polypeptides described herein. In some embodiments, the polynucleotides are operatively linked to one or more heterologous regulatory sequences that control gene expression to create a recombinant polynucleotide capable of expressing the polypeptide. In some embodiments, expression constructs containing at least one heterologous polynucleotide encoding the engineered enzyme polypeptide(s) is introduced into appropriate host cells to express the corresponding enzyme polypeptide(s).

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode an engineered enzyme (e.g., GT or SuS) polypeptide. Thus, the present invention provides methods and compositions for the production of each and every possible variation of enzyme polynucleotides that could be made that encode the enzyme polypeptides described herein by selecting combinations based on the possible codon choices, and all such variations are to be considered specifically disclosed for any polypeptide described herein, including the amino acid sequences presented in the Examples (e.g., in the various Tables).

In some embodiments, the codons are preferably optimized for utilization by the chosen host cell for protein production. For example, preferred codons used in bacteria are typically used for expression in bacteria. Consequently, codon optimized polynucleotides encoding the engineered enzyme polypeptides contain preferred codons at about 40%, 50%, 60%, 70%, 80%, 90%, or greater than 90% of the codon positions in the full length coding region.

In some embodiments, the enzyme polynucleotide encodes an engineered polypeptide having enzyme activity with the properties disclosed herein, wherein the polypeptide comprises an amino acid sequence having at least 60%, 65%, 70%, 75%, 80%, 85%, 86%, 87%, 88%, 89%, 90%, 91%, 92%, 93%, 94%, 95%, 96%, 97%, 98%, 99% or more identity to a reference sequence selected from the SEQ ID NOS provided herein, or the amino acid sequence of any variant (e.g., those provided in the Examples), and one or more residue differences as compared to the reference polynucleotide(s), or the amino acid sequence of any variant as disclosed in the Examples (for example 1, 2, 3, 4, 5, 6, 7, 8, 9, 10 or more amino acid residue positions).

In some embodiments, the polynucleotides are capable of hybridizing under highly stringent conditions to a reference polynucleotide sequence selected from any polynucleotide sequence provided herein, or a complement thereof, or a polynucleotide sequence encoding any of the variant enzyme polypeptides provided herein. In some embodiments, the polynucleotide capable of hybridizing under highly stringent conditions encodes a enzyme polypeptide comprising an amino acid sequence that has one or more residue differences as compared to a reference sequence.

In some embodiments, an isolated polynucleotide encoding any of the engineered enzyme polypeptides herein is manipulated in a variety of ways to facilitate expression of the enzyme polypeptide. In some embodiments, the polynucleotides encoding the enzyme polypeptides comprise expression vectors where one or more control sequences is present to regulate the expression of the enzyme polynucleotides and/or polypeptides. Manipulation of the isolated polynucleotide prior to its insertion into a vector may be desirable or necessary depending on the expression vector utilized. Techniques for modifying polynucleotides and nucleic acid sequences utilizing recombinant DNA methods are well known in the art. In some embodiments, the control sequences include among others, promoters, leader sequences, polyadenylation sequences, propeptide sequences, signal peptide sequences, and transcription terminators. In some embodiments, suitable promoters are selected based on the host cells selection. For bacterial host cells, suitable promoters for directing transcription of the nucleic acid constructs of the present disclosure, include, but are not limited to promoters obtained from the E. coli lac operon, Streptomyces coelicolor agarase gene (dagA), Bacillus subtilis levansucrase gene (sacB), Bacillus licheniformis alpha-amylase gene (amyL), Bacillus stearothermophilus maltogenic amylase gene (amyM), Bacillus amyloliquefaciens alpha-amylase gene (amyQ), Bacillus licheniformis penicillinase gene (penP), Bacillus subtilis xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include, but are not limited to promoters obtained from the genes for Aspergillus oryzae TAKA amylase, Rhizomucor miehei aspartic proteinase, Aspergillus niger neutral alpha-amylase, Aspergillus niger acid stable alpha-amylase, Aspergillus niger or Aspergillus awamori glucoamylase (glaA), Rhizomucor miehei lipase, Aspergillus oryzae alkaline protease, Aspergillus oryzae triose phosphate isomerase, Aspergillus nidulans acetamidase, and Fusarium oxysporum trypsin-like protease (See e.g., WO 96/00787), as well as the NA2-tpi promoter (a hybrid of the promoters from the genes for Aspergillus niger neutral alpha-amylase and Aspergillus oryzae triose phosphate isomerase), and mutant, truncated, and hybrid promoters thereof. Exemplary yeast cell promoters can be from the genes can be from the genes for Saccharomyces cerevisiae enolase (ENO-1), Saccharomyces cerevisiae galactokinase (GAL1), Saccharomyces cerevisiae alcohol dehydrogenase/glyceraldehyde-3-phosphate dehydrogenase (ADH2/GAP), and Saccharomyces cerevisiae 3-phosphoglycerate kinase. Other useful promoters for yeast host cells are known in the art (See e.g., Romanos et al., Yeast 8:423-488 [1992]).

In some embodiments, the control sequence is also a suitable transcription terminator sequence (i.e., a sequence recognized by a host cell to terminate transcription). In some embodiments, the terminator sequence is operably linked to the 3' terminus of the nucleic acid sequence encoding the enzyme polypeptide. Any suitable terminator which is functional in the host cell of choice finds use in the present invention. Exemplary transcription terminators for filamentous fungal host cells can be obtained from the genes for Aspergillus oryzae TAKA amylase, Aspergillus niger glucoamylase, Aspergillus nidulans anthranilate synthase, Aspergillus niger alpha-glucosidase, and Fusarium oxysporum trypsin-like protease. Exemplary terminators for yeast host cells can be obtained from the genes for Saccharomyces cerevisiae enolase, Saccharomyces cerevisiae cytochrome C (CYC1), and Saccharomyces cerevisiae glyceraldehyde-3-phosphate dehydrogenase. Other useful terminators for yeast host cells are known in the art (See e.g., Romanos et al., supra).

In some embodiments, the control sequence is also a suitable leader sequence (i.e., a non-translated region of an mRNA that is important for translation by the host cell). In some embodiments, the leader sequence is operably linked to the 5' terminus of the nucleic acid sequence encoding the enzyme polypeptide. Any suitable leader sequence that is functional in the host cell of choice find use in the present invention. Exemplary leaders for filamentous fungal host cells are obtained from the genes for Aspergillus oryzae TAKA amylase, and Aspergillus nidulans triose phosphate isomerase. Suitable leaders for yeast host cells are obtained from the genes for Saccharomyces cerevisiae enolase (ENO-1), Saccharomyces cerevisiae 3-phosphoglycerate kinase, Saccharomyces cerevisiae alpha-factor, and Saccharomyces cerevisiae alcohol dehydrogenase/glyceraldehyde-3-phosphate dehydrogenase (ADH2/GAP).

In some embodiments, the control sequence is also a polyadenylation sequence (i.e., a sequence operably linked to the 3' terminus of the nucleic acid sequence and which, when transcribed, is recognized by the host cell as a signal to add polyadenosine residues to transcribed mRNA). Any suitable polyadenylation sequence which is functional in the host cell of choice finds use in the present invention. Exemplary polyadenylation sequences for filamentous fungal host cells include, but are not limited to the genes for Aspergillus oryzae TAKA amylase, Aspergillus niger glucoamylase, Aspergillus nidulans anthranilate synthase,

*Fusarium oxysporum* trypsin-like protease, and *Aspergillus niger* alpha-glucosidase. Useful polyadenylation sequences for yeast host cells are known (See e.g., Guo and Sherman, Mol. Cell. Bio., 15:5983-5990 [1995]).

In some embodiments, the control sequence is also a signal peptide (i.e., a coding region that codes for an amino acid sequence linked to the amino terminus of a polypeptide and directs the encoded polypeptide into the cell's secretory pathway). In some embodiments, the 5' end of the coding sequence of the nucleic acid sequence inherently contains a signal peptide coding region naturally linked in translation reading frame with the segment of the coding region that encodes the secreted polypeptide. Alternatively, in some embodiments, the 5' end of the coding sequence contains a signal peptide coding region that is foreign to the coding sequence. Any suitable signal peptide coding region which directs the expressed polypeptide into the secretory pathway of a host cell of choice finds use for expression of the engineered polypeptide(s). Effective signal peptide coding regions for bacterial host cells are the signal peptide coding regions include, but are not limited to those obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57:109-137 [1993]). In some embodiments, effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is also a propeptide coding region that codes for an amino acid sequence positioned at the amino terminus of a polypeptide. The resultant polypeptide is referred to as a "proenzyme," "propolypeptide," or "zymogen." A propolypeptide can be converted to a mature active polypeptide by catalytic or autocatalytic cleavage of the propeptide from the propolypeptide. The propeptide coding region may be obtained from any suitable source, including, but not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those that cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention is directed to a recombinant expression vector comprising a polynucleotide encoding an engineered enzyme polypeptide, and one or more expression regulating regions such as a promoter and a terminator, a replication origin, etc., depending on the type of hosts into which they are to be introduced. In some embodiments, the various nucleic acid and control sequences described herein are joined together to produce recombinant expression vectors which include one or more convenient restriction sites to allow for insertion or substitution of the nucleic acid sequence encoding the enzyme polypeptide at such sites. Alternatively, in some embodiments, the nucleic acid sequence of the present invention is expressed by inserting the nucleic acid sequence or a nucleic acid construct comprising the sequence into an appropriate vector for expression. In some embodiments involving the creation of the expression vector, the coding sequence is located in the vector so that the coding sequence is operably linked with the appropriate control sequences for expression.

The recombinant expression vector may be any suitable vector (e.g., a plasmid or virus), that can be conveniently subjected to recombinant DNA procedures and bring about the expression of the enzyme polynucleotide sequence. The choice of the vector typically depends on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector is one in which, when introduced into the host cell, it is integrated into the genome and replicated together with the chromosome(s) into which it has been integrated. Furthermore, in some embodiments, a single vector or plasmid, or two or more vectors or plasmids which together contain the total DNA to be introduced into the genome of the host cell, and/or a transposon is utilized.

In some embodiments, the expression vector contains one or more selectable markers, which permit easy selection of transformed cells. A "selectable marker" is a gene, the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in filamentous fungal host cells include, but are not limited to, amdS (acetamidase; e.g., from *A. nidulans* or *A. oryzae*), argB (ornithine carbamoyltransferases), bar (phosphinothricin acetyltransferase; e.g., from *S. hygroscopicus*), hph (hygromycin phosphotransferase), niaD (nitrate reductase), pyrG (orotidine-5'-phosphate decarboxylase; e.g., from *A. nidulans* or *A. oryzae*), sC (sulfate adenyltransferase), and trpC (anthranilate synthase), as well as equivalents thereof.

In another aspect, the present invention provides a host cell comprising at least one polynucleotide encoding at least one engineered enzyme polypeptide of the present invention, the polynucleotide(s) being operatively linked to one or more control sequences for expression of the engineered enzyme enzyme(s) in the host cell. Host cells suitable for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells also include various *Escherichia coli* strains (e.g., W3110 (ΔfhuA) and BL21).

Accordingly, in another aspect, the present invention provides methods of producing the engineered enzyme polypeptides, where the methods comprise culturing a host cell capable of expressing a polynucleotide encoding the engineered enzyme polypeptide under conditions suitable for expression of the polypeptide. In some embodiments, the methods further comprise the steps of isolating and/or purifying the enzyme polypeptides, as described herein.

Appropriate culture media and growth conditions for host cells are well known in the art. It is contemplated that any suitable method for introducing polynucleotides for expression of the enzyme polypeptides into cells will find use in the present invention. Suitable techniques include, but are not limited to electroporation, biolistic particle bombardment, liposome mediated transfection, calcium chloride transfection, and protoplast fusion.

Various features and embodiments of the present invention are illustrated in the following representative examples, which are intended to be illustrative, and not limiting.

EXPERIMENTAL

The following Examples, including experiments and results achieved, are provided for illustrative purposes only and are not to be construed as limiting the present invention. Indeed, there are various suitable sources for many of the reagents and equipment described below. It is not intended that the present invention be limited to any particular source for any reagent or equipment item.

In the experimental disclosure below, the following abbreviations apply: M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); psi and PSI (pounds per square inch); ° C. (degrees Centigrade); RT and rt (room temperature); CV (coefficient of variability); CAM and cam (chloramphenicol); PMBS (polymyxin B sulfate); IPTG (isopropyl β-D-1-thiogalactopyranoside); LB (Luria broth); TB (terrific broth); SFP (shake flask powder); CDS (coding sequence); DNA (deoxyribonucleic acid); RNA (ribonucleic acid); nt (nucleotide; polynucleotide); aa (amino acid; polypeptide); *E. coli* W3110 (commonly used laboratory *E. coli* strain, available from the Coli Genetic Stock Center [CGSC], New Haven, Conn.); AcSus (*Acidithiobacillus caldus* sucrose synthase); SUS, SuS, and SuSy (sucrose synthase, also known as sucrose synthetase); NDP (nucleoside diphosphate); adenosine diphosphate (ADP); cytidine diphosphate (CDP); guanosine diphosphate (GDP); thymidine diphosphate (TDP); uridine diphosphate (UDP); inosine diphosphate (IDP); GT (glycosyltransferase); UGT (UDP-glucose-dependent glycosyltransferase); NGT (NDP-nucleoside diphosphate-dependent glycosyltransferase); AGT (ADP-glucose-dependent glycosyltransferase); CGT (CDP-glucose-dependent glycosyltransferase); GGT (GDP-glucose-dependent glycosyltransferase); TGT (TDP-glucose-dependent glycosyltransferase); IGT (IDP-glucose-dependent glycosyltransferase); UGT (UDP-glucose-dependent glycosyltransferase); reb (rebaudioside); rebA (rebaudioside A); rebD (rebaudioside D); rebI (rebaudioside I); rebM (rebaudioside M); "Reb A 60" is a ~1:2 mixture of stevioside and rebaudioside A respectively; HTP (high throughput); HPLC (high pressure liquid chromatography); HPLC-UV (HPLC-Ultraviolet Visible Detector); 1H NMR (proton nuclear magnetic resonance spectroscopy); HSQC NMR (heteronuclear single quantum coherence spectroscopy NMR); COSY NMR (homonuclear correlation spectroscopy NMR); Acorn (Acorn NMR, Livermore, Calif.); FIOPC (fold improvements over positive control); Sigma and Sigma-Aldrich (Sigma-Aldrich, St. Louis, Mo.; Difco (Difco Laboratories, BD Diagnostic Systems, Detroit, Mich.); Microfluidics (Microfluidics, Westwood, Mass.); ChromaDex (ChromaDex, Inc., Irvine, Calif.); Life Technologies (Life Technologies, a part of Fisher Scientific, Waltham, Mass.); Amresco (Amresco, LLC, Solon, Ohio); Carbosynth (Carbosynth, Ltd., Berkshire, UK); Varian (Varian Medical Systems, Palo Alto, Calif.); Agilent (Agilent Technologies, Inc., Santa Clara, Calif.); and Thermotron (Thermotron, Inc., Holland, Mich.).

Example 1

Synthesis, Optimization, and Assays

In this Example, methods used in the synthesis, optimization and assaying of UGT enzymes with glucosylation activity are described.

Gene Synthesis and Optimization:

The polynucleotide sequence (SEQ ID NO: 1) encoding the wild-type *Stevia rebaudiana* polypeptide (SEQ ID NO: 2) reported to glucosylate steviolbioside to rebaudioside B and glucosylate stevioside to rebaudioside A (See e.g., Richman et al., Plant J., 41:56-67 [2005]), was codon-optimized and synthesized as the gene of SEQ ID NO: 3. This synthetic gene (SEQ ID NO: 3) was cloned into a pCK110900 vector system (See e.g., US Pat. Appln. Publn. No. 2006/0195947, which is hereby incorporated by reference herein) and subsequently expressed in *E. coli* W3110 (ΔfhuA). The *E. coli* strain W3110 expressed the UGT enzymes under the control of the lac promoter. Rounds of evolution were conducted as described in the following Examples.

Production of Shake Flask Powders (SFP):

A shake-flask procedure was used to generate the glycosyltransferase polypeptide shake flask powders (SFP) for characterization assays used in the biocatalytic processes described herein. Shake flask powder (SFP) preparation of enzymes provides a more purified preparation (e.g., up to >30% of total protein) of the enzyme as compared to the cell lysate used in HTP assays and also allows for the use of more concentrated enzyme solutions. A single colony of *E. coli* containing a plasmid encoding an engineered polypeptide of interest was inoculated into 5 mL Luria Bertani broth containing 30 μg/ml chloramphenicol and 1% glucose. Cells were grown overnight (at least 16 hours) in an incubator at 30° C. with shaking at 250 rpm. The culture was diluted into 250 mL Terrific Broth (12 g/L bacto-tryptone, 24 g/L yeast extract, 4 mL/L glycerol, 65 mM potassium phosphate, pH 7.0, 1 mM MgSO4) containing 30 μg/ml CAM, in a 1 L flask to an optical density of 600 nm (OD600) of 0.2 and allowed to grow at 30° C.

Expression of the glycosyltransferase gene was induced by addition of IPTG to a final concentration of 1 mM when the OD600 of the culture was 0.6 to 0.8. Incubation was then continued overnight (at least 16 hours). Cells were harvested by centrifugation (5000 rpm, 15 mM, 4° C.) and the supernatant discarded. The cell pellet was resuspended in two volumes of 25 mM triethanolamine buffer, pH 7.5, and passed through a MICROFLUIDIZER® high pressure homogenizer (Microfluidics), with standard *E. coli* lysis settings and maintained at 4° C. Cell debris was removed by centrifugation (10,000 rpm, 45 minutes, 4° C.). The cleared lysate supernatant was collected and frozen at −80° C. and then either His-affinity purified and dialyzed to produce purified protein or lyophilized to produce a dry shake-flask powder of crude protein.

Assay of SFP for Stevioside Glucosylation:

SFP was reconstituted to provide 20 g/L powder. Then, 50 μL of these stocks were diluted in 200 μL total reaction volume of 50 mM Tris-HCl buffer, pH 7.5, with 3 mM MgSO4 and 1 mM stevioside (ChromaDex, >94% purity), with 2 mM uridine diphosphoglucose. The reaction was performed at 30° C. in a THERMOTRON® titre-plate shaker with 300 RPM shaking for 16-18h.

HPLC-MS/MS Analysis:

The reaction described above was quenched with 0.5 volume/volume acetonitrile with 0.2% formic acid and precipitated by centrifugation. Glycosylated stevioside products were detected in the supernatant by LC-MS/MS with the following instrument and parameters:

TABLE 1.1

HPLC-MS/MS Analysis of Steviol Glycosides

| | |
|---|---|
| Instrument | Agilent HPLC 1200 series, Sciex 4000 QTrap |
| Column | Poroshell 120 EC C18 50 × 3.0 mm, 2.7 μm with Poroshell 120 EC C18 5 × 3.0, 2.7 μm guard column (Agilent Technologies) |
| Mobile phase | Gradient (A: 0.1% formic acid in water, B: 0.1% formic acid in methanol) |

| Time (m) | % B |
|---|---|
| 0 | 60 |
| 0.50 | 60 |
| 1.00 | 70 |
| 4.33 | 70 |
| 5.00 | 95 |
| 5.33 | 9 |
| 5.34 | 60 |
| 6.00 | 60 |

| | |
|---|---|
| Flow rate | 0.8 mL/m |
| Run time | 6 m |
| Peak retention times | Rebaudioside A: 2.35 m |
| Column temperature | 40° C. |
| Injection volume | 10 μL |
| MS detection | MRM 990/828 (for steviol tetraglycosides, e.g., rebaudioside A), 1152/828 (for steviol pentaglycosides, e.g., rebaudioside D), 1314/828 (steviol hexaglycosides, e.g., rebaudioside M), 828/666 (for steviol triglycosides, e.g., stevioside), 666/504 (steviol diglycosides, e.g., rubusoside) |
| MS conditions | MODE: MRM; CUR: 30; IS: 4750; CAD: high; TEM: 550° C.; GS1: 50; GS2: 50; DP: 150; EP: 10; CXP: 14; DT: 50 ms for each transition. For the first three transitions CE: 85; for the last two transitions CE: 60. |

Activity was detected for SEQ ID NO:4. High conversion (i.e., >95%), of stevioside to rebaudioside A was observed in the LC-MS/MS analysis of the assay samples described above.

Example 2

GT Variants of SEQ ID NO: 4

In this Example, experiments for evolution and screening of GT polypeptides derived from SEQ ID NO: 4 for improved glucosylation of steviol glycosides using ADP-glucose are described. Directed evolution of the GT encoded by SEQ ID NO: 3 (i.e., SEQ ID NO:4) was carried out by constructing libraries of variant genes in which positions associated with certain structural features of the enzyme were subjected to mutagenesis. These libraries were then plated, grown, and screened using the high-throughput (HTP) assay described below to provide a first round ("Round 1") of engineered GT variant polypeptides with glucosyltransferase activity toward ADP-glucose and steviol glycosides. Many additional rounds of evolution were conducted by constructing libraries of variant genes in which mutations associated with improved activity in Round 1 and then subsequent rounds of evolution were recombined. These libraries were then plated, grown, and screened using the high-throughput (HTP) growth, expression, lysate preparation, and assay described below.

HTP Growth, Expression, and Lysate Preparation

Cells were picked into 96-well plates and grown overnight in LB media containing 1% glucose and 30 μg/mL CAM, 30° C., 200 rpm, 85% humidity. Then, 20 µL of overnight growth were transferred to a deep-well plate containing 380 µL TB growth media containing 30 µg/mL CAM, induced with 1 mM IPTG, and incubated for 18 h at 30° C., 200 rpm, 85% humidity. Cell cultures were centrifuged at 4000 rpm, 4° C. for 10 m, and the media discarded. Cell pellets thus obtained were frozen at −80° C., and lysed in 250 µL lysis buffer (0.5 g/L lysozyme and 0.5 g/L PMBS in 20 mM Tris-HCl buffer, pH 7.5) with low-speed shaking for 2 h on titre-plate shaker at room temperature. The plates were then centrifuged at 4000 rpm and 4° C. for 20 mM and the cleared lysate supernatants were used in the HTP assay reactions described below.

HTP Assay for Glucose Transfer from ADP-Glucose to Stevioside:

Assays were performed on 96-well plates of cleared E. coli culture lysates expressing SEQ ID NO: 3 variants with lysate loading of 50 µL lysate in 200 µL reactions and with substrate loading of 1 mM stevioside (ChromaDex, >94% purity), from a 20 mM stock solution in 50% ethanol and co-substrate loading of 0.5 mM ADP-glucose (Sigma, >93% purity). The following reaction conditions were used: 50 mM Tris-HCl buffer, pH 7.5, 3 mM MgCl$_2$, 30° C. in a THERMOTRON® titre-plate shaker with 300 RPM shaking for 18 h. The reactions were quenched with 100 µL/well acetonitrile with 0.2% formic acid, centrifuged 10 m at 4° C., and the supernatants were analyzed by HPLC-MS/MS as described in Example 1, Table 1.1.

Formation of rebaudioside A from stevioside in the presence of wild-type UGT76G1 (SEQ ID NO:4) with ADP-glucose was indistinguishable from a no enzyme control. In contrast to the wild-type enzyme of SEQ ID NO:4, glycosyltransferase variant polypeptides were identified that produced rebaudioside A from stevioside with ADP-glucose. The engineered polypeptides are listed in Table 2.1. Although the parent and variant constructs contain an N-terminal histidine tag for affinity purification, the mutations were numbered relative to the untagged reference sequence for clarity. Shake-flask scale cultures of the variants produced during multiple rounds of evolution were grown for protein purification as described in Example 1.

Example 3

Synthesis, Optimization, and Assaying of Glycosyltransferase Enzymes with Glucosylation Activity In this Example, methods used in the synthesis, optimization and assaying of UGT enzymes with glucosylation activity are described.

Gene Synthesis and Optimization

The polynucleotide sequence encoding a beta-1,2 glycosyltransferase Solanum tuberosum was codon-optimized and synthesized as the gene of SEQ ID NO: 11. These synthetic genes were cloned into a pCK110900 vector system (See e.g., U.S. Pat. No. 9,714,437, which is hereby incorporated by reference) and subsequently expressed in E. coli W3110 (ΔfhuA). The E. coli strain W3110 expressed the UGT enzymes under the control of the lac promoter.

Production of Shake Flask Powders (SFP)

A shake-flask procedure was used to generate the glycosyltransferase polypeptide shake flask powders (SFP) for characterization assays used in the biocatalytic processes described herein. Shake flask powder (SFP) preparation of enzymes provides a more purified preparation (e.g., up to >30% of total protein) of the enzyme as compared to the cell lysate used in HTP assays and also allows for the use of more concentrated enzyme solutions. A single colony of E. coli containing a plasmid encoding an engineered polypeptide of interest was inoculated into 5 mL Luria Bertani broth containing 30 µg/ml chloramphenicol and 1% glucose. Cells were grown overnight (at least 16 hours) in an incubator at 30° C. with shaking at 250 rpm. The culture was diluted into 250 mL Terrific Broth (12 g/L bacto-tryptone, 24 g/L yeast extract, 4 mL/L glycerol, 65 mM potassium phosphate, pH 7.0, 1 mM MgSO$_4$) containing 30 µg/ml CAM, in a 1 L flask to an optical density of 600 nm (OD600) of 0.2 and allowed to grow at 30° C.

Expression of the glycosyltransferase gene was induced by addition of IPTG to a final concentration of 1 mM when the OD600 of the culture was 0.6 to 0.8. Incubation was then continued overnight (at least 16 hours). Cells were harvested by centrifugation (5000 rpm, 15 min, 4° C.) and the supernatant discarded. The cell pellet was resuspended in two volumes of 25 mM triethanolamine buffer, pH 7.5, and passed through a MICROFLUIDIZER® high pressure homogenizer (Microfluidics), with standard E. coli lysis settings and maintained at 4° C. Cell debris was removed by centrifugation (10,000 rpm, 45 minutes, 4° C.). The cleared lysate supernatant was collected and frozen at −80° C. and then either His-affinity purified and dialyzed to produce purified protein or lyophilized to produce a dry shake-flask powder of crude protein.

Assay for Rebaudioside A Glucosylation with Purified Proteins

First, 50 µL purified protein was diluted in 200 µL total reaction volume consisting of 50 mM Tris-HCl buffer pH 7.5, 3 mM magnesium chloride, 1 mM rebaudioside A, and 0.5 mM uridine diphosphoglucose. The reaction was performed at 30° C. in a THERMOTRON® titre-plate shaker with 300 RPM shaking for 18 h. Boiled enzyme reaction was used as the negative control. Ten µL of the reaction was quenched with 90 µL acetonitrile with 0.2% formic acid and precipitated by centrifugation. Glycosylated rebaudioside A products were detected in the supernatant by LC-MS/MS as described in Example 1, Table 1.1. Despite poor soluble expression, SEQ ID NO: 12 demonstrated high specific activity and good selectivity toward producing β-1,2-glucose linkages in the steviol glycoside substrates.

Assay for Rebaudioside A Glucosylation with Shake Flask Powder

Lyophilized shake flask powder was reconstituted to 20 mg/mL. Then, 10 µL of these stocks were diluted in 100 µL total reaction volume of 50 mM potassium phosphate (KPhos) buffer, pH 7, with 3 mM MgCl$_2$, 1 mM rebaudioside A (>97% purity), and 2 mM uridine diphosphoglucose (UDP-glucose). The reaction was performed at 40° C. in a THERMOTRON® titre-plate shaker with 300 RPM shaking for 16-18 h. Activity was detected for SEQ ID NO: 12 over negative control. Low conversion (i.e., <10%), of rebaudioside A to rebaudioside D was observed in the LC-MS/MS analysis.

Example 4

GT Variants of SEQ ID NO: 12

In this Example, experiments for evolution and screening of GT polypeptides derived from SEQ ID NO: 12 for improved glucosylation of steviol glycosides are described. Directed evolution of the GT encoded by SEQ ID NO: 11 (i.e., SEQ ID NO: 12) was carried out by constructing combinatorial libraries of variant genes in which positions associated with surface residues of the enzyme were subjected to mutagenesis. These libraries were then plated, grown, and screened using the high-throughput (HTP) assay described below to provide a first round ("Round 1") of engineered GT variant polypeptides with β-1,2-glucosyltransferase activity toward steviol glycosides. Many additional rounds of evolution were conducted by constructing libraries of variant genes in which mutations associated with improved activity in Round 1 and then subsequent rounds of evolution were recombined. These libraries were then plated, grown, and screened using the high-throughput (HTP) growth, expression, lysate preparation, and assay described below.

HTP Growth, Expression, and Lysate Preparation

Cells were picked into 96-well plates and grown overnight in LB media containing 1% glucose and 30 μg/mL CAM, 30° C., 200 rpm, 85% humidity. Then, 20 μL of overnight growth were transferred to a deep-well plate containing 380 μL TB growth media containing 30 μg/mL CAM, induced with 1 mM IPTG, and incubated for 18 h at 30° C., 200 rpm, 85% humidity. Cell cultures were centrifuged at 4000 rpm, 4° C. for 10 m, and the media discarded. Cell pellets thus obtained were frozen at −80° C., and lysed in 250 μL lysis buffer (0.5 g/L lysozyme and 0.5 g/L PMBS in 20 mM Tris-HCl buffer, pH 7.5) with low-speed shaking for 2 h on titre-plate shaker at room temperature. The plates were then centrifuged at 4000 rpm and 4° C. for 20 mM and the cleared lysate supernatants were used in the HTP assay reactions described below.

HTP Assay for Rebaudioside A Glucosylation

Assays were performed on 96-well plates of cleared *E. coli* culture lysates expressing enzyme variants with lysate loading of 25 μL lysate in 100 μL reactions and with substrate loading of 1 mM rebaudioside A (Sigma, >96% purity), from a 20 mM stock solution in 50% ethanol, and co-substrate loading of 0.5 mM UDP-glucose (Sigma, >98% purity). The following reaction conditions were used: 50 mM Tris-HCl buffer, pH 7.5, 3 mM MgCl$_2$, 30° C. in a THERMOTRON® titre-plate shaker with 300 RPM shaking for 4 h. The reactions were quenched with 0.5 volume/volume acetonitrile with 0.2% formic acid and precipitated by centrifugation for 10 m at 4° C. Glycosylated products were detected in the supernatant by LC-MS/MS following 1:20 dilution in water with the instrument and parameters described in Example 1, Table 1.1. Glycosyltransferase variant polypeptides that produced rebaudioside D from rebaudioside A at greater quantities than the reference backbone sequence were identified and used in subsequent rounds of evolution. Shake-flask scale cultures were grown for lyophilized powder production as described in Example 1 for analysis of variants.

Shake Flask Lysate Characterization Assay and Analysis for Rebaudioside A Glucosylation First, 250 mL shake flask cultures were grown, induced, and lysed. Cell debris was removed by centrifugation as described in Example 1, and the cleared lysate supernatant was collected. Then, 10 μL of the lysate were diluted in 100 μL total reaction volume of 50 mM Tris-HCl buffer, pH 7.5, 3 mM MgCl$_2$, 1 mM rebaudioside A (Sigma, >96% purity), and 2 mM UDP-glucose (Sigma, >98% purity). The reaction was performed at 30° C. in a THERMOTRON® titre-plate shaker with 300 RPM shaking for 0-18 h. The reaction described above was quenched with 0.5 volume/volume acetonitrile with 0.2% formic acid and precipitated by centrifugation. Glycosylated products were detected in the supernatant by LC-MS/MS following 1:20 dilution in water with the instrument and parameters described in Example 1, Table 1.1.

Example 5

Sucrose Synthase Variants of SEQ ID NO: 6

In this Example, experiments for the evolution and screening of sucrose synthase (SuS) polypeptides derived from a codon-optimized *Acidothiobacillus caldus* sucrose synthase polynucleotide (SEQ ID NO: 5) for improved production of ADP-glucose from sucrose and ADP are described. Directed evolution of the SuS encoded by SEQ ID NO: 5 (i.e., SEQ ID NO: 6) was carried out by constructing libraries of variant genes in which positions associated with certain structural features of the enzyme were subjected to saturation mutagenesis and diversity from homologs in publically available databases was recombined. These libraries were then plated, grown, and screened using the high-throughput (HTP) assay described below to provide a first round ("Round 1") of engineered SuS variant polypeptides with improved activity toward synthesizing ADP-glucose. Many additional rounds of evolution were conducted by constructing libraries of variant genes in which mutations associated with improved activity in Round 1 and then subsequent rounds of evolution were recombined. These libraries were then plated, grown, and screened using the high-throughput (HTP) growth, expression, lysate preparation, and assay described below.

HTP Assay for Glucose Transfer from Sucrose to ADP

Assays were performed on 96-well plates of cleared *E. coli* culture lysates expressing SEQ ID NO: 5 variants (i.e., variants of SEQ ID NO: 6) with lysate loading of 25 μL lysate in 100 μL reactions and with substrate loading of 30% w/v sucrose (Sigma) from a 60% stock solution in water and co-substrate loading of 2 mM ADP (Sigma, >95%). The following reaction conditions were used: 50 mM Tris-HCl buffer, pH 7.5, 3 mM MgCl$_2$, 30° C. in a Thermocycler for 2 h. The reactions were heat quenched at 95° C. for 10 minutes, and then analyzed by a colorimetric D-fructose dehydrogenase assay adapted from the literature (See e.g., Ameyama et al., J. Bacteriol., 145:814-823 [1981]; and Ameyama, Meth. Enzymol., 89:20-29 [1982]). Briefly, an overnight enzyme-coupled assay was conducted in 96-well plates with 20 μL sample, diluted such that fructose concentration is <1 g/L, 20 μL 100 mM potassium ferricyanide (Sigma P-8131), and 160 μL 0.8 units/mL fructose dehydrogenase (Sigma F4892) dissolved in pH 4.6 McIlvaine buffer with 0.1% Triton X-100. This reaction quantitatively converts fructose to K$_4$Fe(CN)$_6$, which is then quantified colorimetrically by adding 67 μL of the overnight reaction to 33 μL of stop solution (0.3% w/v sodium dodecyl sulfate, Sigma L-4509, 8.1% v/v phosphoric acid, Sigma P-6560, and 0.5% w/v ferric sulfate, Sigma F-1135) and shaking for 20 minutes to allow for complete conversion of K$_4$Fe(CN)$_6$ to Prussian blue, the absorbance of which is read on a plate reader at a wavelength of 690 nm. Following the primary assay, engineered sucrose synthase (SuS) variant polypeptides with higher fructose, and therefore higher stoichiometric ADP-glucose, formation activity than SEQ ID NO: 6 were screened in triplicate at a lower substrate load of 2% w/v sucrose (Sigma) and co-substrate load of 1 mM ADP (Sigma, >95%).

HTP Coupled Assay for Glucose Transfer from Sucrose to ADP to Rebaudioside D

Libraries were screened using the following HTP enzyme-coupled assay. Pelleted *E. coli* cultures were lysed with 250 μL of Tris-HCl, pH 7.5, with 1 mM magnesium sulfate and 0.5 mg/mL lysozyme and polymyxin B sulfate (PMBS) and cleared by centrifugation. Lysate was diluted 20× into Tris-HCl, pH 7.5. Then, 10 μL diluted SuS lysate and 2 g/L GT SEQ ID NO: 8 were combined in 100 μL reaction volume with substrate loading of ~1 mM rebaudioside D and co-substrate loadings of 1 Mm ADP (Sigma, >95%) and 10 mM sucrose (Sigma). The following reaction conditions were used: 50 mM potassium phosphate buffer, pH 7, 3 mM $MgCl_2$, 50° C., in a THERMOTRON® titre-plate shaker with 300 RPM shaking for 2 h. The reaction described above was quenched by adding 10 μL assay mixture to 90 μL acetonitrile with 0.2% formic acid, and precipitated by centrifugation. The supernatant was diluted 10× in water and steviol glycoside products were detected by RapidFire SPE-MS/MS, with the instrument and parameters described in Table 5.1.

TABLE 5.1

RapidFire SPE-MS/MS Conditions for Steviol Glycoside Detection.
Agilent RapidFire Conditions

| | |
|---|---|
| Buffer A | 0.1% formic acid in LC/MS grade water; 1.5 mL/min flow rate |
| Buffer B | 0.1% formic acid in LC/MS grade methanol; 0.8 mL/min flow rate |
| Aqueous wash | Water |
| Organic wash | Acetonitrile |
| SPE cartridge | Agilent RapidFire cartridge A (C4) |
| RF state 1 | 600 ms |
| RF state 2 | 2500 ms |
| RF state 3 | 0 |
| RF state 4 | 5000 ms |
| RF state 5 | 1000 ms |
| Agilent Jet Stream Source Parameters | |
| Drying gas temperature | 300° C. |
| Drying gas flow | 10 L/min |
| Nebulizer pressure | 45 psi |
| Sheath gas temperature | 350° C. |
| Sheath gas flow | 11 L/min |
| Capillary voltage | +3500 V |
| Nozzle voltage | +2000 V |

Agilent 6470 Triple Quadrupole MRM Parameters

| Compound | Q1 | Q3 | Dwell | Fragmentor | CE | CAV |
|---|---|---|---|---|---|---|
| Stevioside | 827.4 | 665.3 | 50 | 150 | 50 | 5 |
| RebA | 989.5 | 827.5 | 50 | 350 | 60 | 5 |
| RebD or RebI | 1151.7 | 827.5 | 50 | 350 | 55 | 5 |
| RebM | 1313.7 | 827.5 | 50 | 350 | 70 | 5 |

Production of Shake Flask Powders (SFP)

A shake-flask procedure was used to generate the glycosyltransferase polypeptide shake flask powders (SFP) for characterization assays used in the biocatalytic processes described herein. Shake flask powder (SFP) preparation of enzymes provides a more purified preparation (e.g., up to >30% of total protein) of the enzyme, as compared to the cell lysate used in HTP assays, and also allows for the use of more concentrated enzyme solutions. A single colony of *E. coli* containing a plasmid encoding an engineered polypeptide of interest was inoculated into 5 mL Luria Bertani broth containing 30 μg/ml chloramphenicol and 1% glucose. Cells were grown overnight (at least 16 hours) in an incubator at 30° C. with shaking at 250 rpm. The culture was diluted into 250 mL Terrific Broth (12 g/L bacto-tryptone, 24 g/L yeast extract, 4 mL/L glycerol, 65 mM potassium phosphate, pH 7.0, 1 mM $MgSO_4$) containing 30 μg/ml CAM, in a 1 L flask to an optical density of 600 nm (OD600) of 0.2, and allowed to grow at 30° C.

Shake Flask Powder Characterization Assay and Analysis for Glucosyl Transfer from Sucrose to Rebaudioside D An experiment was performed to characterize the activity of the engineered SUS variants on sucrose and ADP to facilitate the formation of rebaudioside M from rebaudioside D. Shake flask powder (SFP) was added to a 100 μL total reaction volume at 0.125 g/L concentration containing 50 mM potassium phosphate buffer, pH 7, 3 mM magnesium chloride, 1 g/L rebaudioside D, 10 mM sucrose, 1 mM ADP, and 2 g/L GT SEQ ID NO: 10. The reaction was performed at 50° C. in a THERMOTRON® titre-plate shaker with 300 RPM shaking for 1 h. The reaction was quenched by adding 10 μL of the reaction mixture to 90 μL acetonitrile with 0.2% formic acid, and precipitated by centrifugation. The supernatant was diluted 10× in water and analyzed for steviol glycosides by RapidFire SPE-MS/MS, with the instrument and parameters described in Table 5.1. Based on these results, additional rounds of evolution were conducted to optimize the enzymes.

Example 6

Sucrose Synthase Variants

Directed evolution of the sucrose synthase enzymes was continued by constructing libraries of variant genes in which mutations associated with improved activity in earlier rounds of evolution were recombined. These libraries were then plated, grown, and screened using the high-throughput (HTP) assay described below, to provide additional iterative rounds engineered SuS variant polypeptides with activity toward the generation of ADP-glucose.

HTP Coupled Assay for Glucose Transfer from Sucrose to ADP to Rebaudioside A

Combinatorial libraries were screened using the following HTP enzyme-coupled assay. Pelleted *E. coli* cultures were lysed with 400 μL of Tris-HCl, pH 7.5 with 1 mM magnesium sulfate and 0.5 mg/mL lysozyme and polymyxin B sulfate (PMBS), and cleared by centrifugation. Lysate was diluted ~90× into Tris-HCl, pH 7.5. Then, 10 μL diluted SuS lysate and 1 g/L GT SEQ ID NO: 14 were combined in 100 μL reaction volume with substrate loading of 4.5-7.5 mM rebaudioside A 97 and co-substrate loadings of 0.2-0.25 mM ADP (Sigma, >95%) and 30 mM sucrose (Sigma). The following reaction conditions were used: 50 mM potassium phosphate buffer, pH 6, 55° C. in a THERMOTRON® titre-plate shaker with 300 RPM shaking for 2 h. The reaction described above was solubilized by adding 10 μL assay to 90-190 μL water, quenched by adding 10 μL solubilized assay to 90 μL acetonitrile with 0.2% formic acid, and precipitated by centrifugation. The supernatant was diluted 4.4-6.7× in water and steviol glycoside products were detected by RapidFire SPE-MS/MS, with the instrument and parameters described in Table 5.1. After analysis, engineered SuS variant polypeptides that showed improved activity coupled with a GT on rebaudioside A were identified.

Shake Flask Powder Characterization Assay and Analysis for Glucosyl Transfer from Sucrose to Rebaudioside A Experiments were performed to characterize the activity of the engineered SUS variants on sucrose and ADP to facilitate the formation of rebaudioside D from rebaudioside A. Shake flask powder (SFP) was added to a 100 µL total reaction volume at 0.02 g/L concentration containing 50 mM potassium phosphate buffer, pH 6, 7.5 mM rebaudioside A 97, 30 mM sucrose, 0.2 mM ADP, and 1 g/L GT SEQ ID NO: 14. The reaction was performed at 50° C. in a THERMOTRON® titre-plate shaker with 300 RPM shaking for 1 h. The reaction was solubilized by diluting 20× into water, quenched by adding 10 µL of the diluted reaction to 90 µL acetonitrile with 0.2% formic acid, and precipitated by centrifugation. The supernatant was diluted 4.4× in water and analyzed for steviol glycosides by RapidFire SPE-MS/MS, with the instrument and parameters described in Table 5.1. Variants with higher activities than the reference sequences and higher levels of rebaudioside D produced from rebaudioside A were selected for further directed evolution for the catalysis of the recycling reaction transferring a glucose from sucrose to ADP.

Example 7

Beta-1,3-ADP-Glycosyltransferase Variants of SEQ ID NO: 20

In this Example, experiments for evolution and screening of β1,3-glycosyltransferase (β1,3GT) polypeptides derived from SEQ ID NO: 20 for improved glucosylation of steviol glycosides using in situ synthesized ADP-glucose are described. Directed evolution of the GT encoded by SEQ ID NO: 19 (i.e., SEQ ID NO: 20) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide another round of 72 engineered GT variant polypeptides with glucosyltransferase activity toward ADP-glucose and steviol glycosides.

HTP Assay for Glucose Transfer from Sucrose to ADP and then from ADP-Glucose to Rebaudioside A 60

Assays were performed on 96-well plates of cleared E. coli culture lysates expressing SEQ ID NO: 19 variants (i.e., variants of SEQ ID NO: 20). Pellets were lysed, and lysate was cleared as described in Example 6, and then diluted 10× into 50 mM potassium phosphate buffer, pH 6. In order to thermally challenge the lysates, they were pre-incubated at 75° C. in a Thermotron® titre-plate shaker with 300 RPM shaking for 1 h. Assays were conducted with 10 µL pre-incubated lysate in 100 µL reactions and with 20 g/L rebaudioside A 60% substrate, 0.025 g/L ADP (Amresco, ultra pure grade) co-substrate, 0.05 g/L SUS SFP SEQ ID NO: 18, 0.12 g/L β-1,2-glycosyltransferase (β12GT) SEQ ID NO: 16, and 40 g/L sucrose (cane sugar). The following reaction conditions were used: 50 mM potassium phosphate buffer, pH 6, 60° C. in a THERMOTRON® titre-plate shaker with 300 RPM shaking for 16 h. Reactions were solubilized by 20× dilution with water, quenched by 5× dilution with acetonitrile with 0.2% formic acid, and diluted 20× with water for analysis. Samples were analyzed by RapidFire-MS/MS as described in Example 5, Table 5.1. Glycosyltransferase variant polypeptides that produced rebaudioside M from rebaudioside A 60 with in situ synthesized ADP-glucose at greater quantities than SEQ ID NO: 20 were identified. The engineered polypeptides are listed in Table 7.1 and Table 7.2. Shake-flask scale cultures were grown, lysed, cleared, and lyophilized to powder as described in Example 1 for analysis of variants shown in Table 7.3 relative to SEQ ID NO: 20.

TABLE 7.1

β1,3GT Combinatorial Variants and RebM Levels

| SEQ ID NO: (nt/aa) | Amino Acid Differences (Relative to SEQ ID NO: 20) | Increased RebM[a] |
|---|---|---|
| 25/26 | H81T/K139N/M144Q/H195Q/K200R/D204T/I207V/W233Q | +++ |
| 27/28 | H81T/Q197K/K200R/I207V/W233Q/C338A | +++ |
| 29/30 | A41E/T72P/C338A | +++ |
| 31/32 | M144Q/W233T/C338V | +++ |
| 33/34 | T72P/M144Q/C338V | +++ |
| 35/36 | A41E/T72P/W233Q/C338A | +++ |
| 37/38 | R76S/M144Q/Q197K/K200R | +++ |
| 39/40 | K200R/D204T/I207V/W233T | +++ |
| 41/42 | H81T/M144Q/W233Q | +++ |
| 43/44 | T72P/K200R/D204T/I207V | ++ |
| 45/46 | T72P/H81T/H195Q/W233Q | ++ |
| 47/48 | Q61D/E259T/K428I | ++ |
| 49/50 | A41E/W233T/C338V | ++ |
| 51/52 | A41E/W233Q | ++ |
| 53/54 | M144Q/W233T | ++ |
| 55/56 | W233Q/C338V | ++ |
| 57/58 | R76S/Q197K/I207V/W233Q | ++ |
| 59/60 | H81T/C338V | ++ |
| 61/62 | A41E/W233Q/C338V | ++ |
| 63/64 | K139N/M144Q/W233Q | ++ |
| 65/66 | A41E/M144Q/W233T | ++ |
| 67/68 | R76S/H195Q/Q197K/D204T/I207V/W233T | ++ |
| 69/70 | T72P/R76S/L163A/Q197K | ++ |
| 71/72 | T72P/I207V | ++ |
| 73/74 | T72P/R76T/Q197K/D204T | + |
| 75/76 | L163A/W233T/C338A | + |
| 77/78 | T72P/R76S/I207V/C338V | + |
| 79/80 | T72P/R76S | + |
| 81/82 | T72P | + |
| 83/84 | T72P/R76T | + |
| 85/86 | A41E/W233T | + |
| 87/88 | T72P/R76T/I207V/W233Q | + |
| 89/90 | T72P/R76T/H195Q/W233T | + |
| 91/92 | T72P/H81T | + |
| 93/94 | T72P/K139N/H195Q/D204T | + |
| 95/96 | R76S/W233T | + |
| 97/98 | H81T/W233Q/C338V | + |
| 99/100 | Q61D | + |
| 101/102 | Q61E/R411T | + |
| 103/104 | Q61D/A87K/Q91L/A107L | + |
| 105/106 | Q61E/Q91L/D431M | + |
| 107/108 | Q61D/A87K/Q91L/E259T | + |
| 109/110 | A107V/E259T | + |
| 111/112 | A107V | + |
| 113/114 | Q61D/I407T/K428I | + |
| 115/116 | Q61D/A107V | + |
| 117/118 | C156S/I407T | + |
| 119/120 | E259T | + |
| 121/122 | Q61E/A87K/Q91L/A107V | + |

[a]Levels of increased production were determined relative to the reference polypeptide of SEQ ID NO: 20, and defined as follows: "+" = at least 1.24-fold that of the reference but less than 1.36-fold increased production; "++" = at least 1.36-fold but less than 1.43-fold increased production relative to reference polypeptide; and "+++" = at least 1.43-fold increased production.

TABLE 7.2

β1,3GT Saturation Mutagenesis Variants and RebM Levels

| SEQ ID NO: (nt/aa) | Amino Acid Differences (Relative to SEQ ID NO: 20) | Increased RebM at 60° C.[a] | Increased RebM at 65° C.[a] |
|---|---|---|---|
| 123/124 | A85V | ++ | ++ |
| 125/126 | H81L | ++ | + |
| 127/128 | A124P | ++ | − |
| 129/130 | T80P | ++ | ++ |
| 131/132 | H81A | ++ | ++ |

TABLE 7.2-continued

β1,3GT Saturation Mutagenesis Variants and RebM Levels

| SEQ ID NO: (nt/aa) | Amino Acid Differences (Relative to SEQ ID NO: 20) | Increased RebM at 60° C.[a] | Increased RebM at 65° C.[a] |
|---|---|---|---|
| 133/134 | H81M | ++ | + |
| 135/136 | H81V/Q270K | ++ | ++ |
| 137/138 | H81T | ++ | ++ |
| 139/140 | H81V | ++ | + |
| 141/142 | V286L | ++ | − |
| 143/144 | H81S | ++ | + |
| 145/146 | T80D | ++ | ++ |
| 147/148 | A85T | ++ | + |
| 149/150 | P83D | + | − |
| 151/152 | Q71G | + | + |
| 153/154 | A97V | + | − |
| 155/156 | S456K | + | − |
| 157/158 | E420R | + | + |
| 159/160 | T263C | + | + |
| 161/162 | I334V | + | − |

TABLE 7.2-continued

β1,3GT Saturation Mutagenesis Variants and RebM Levels

| SEQ ID NO: (nt/aa) | Amino Acid Differences (Relative to SEQ ID NO: 20) | Increased RebM at 60° C.[a] | Increased RebM at 65° C.[a] |
|---|---|---|---|
| 163/164 | Q71T | + | − |
| 165/166 | T80Q | − | + |
| 167/168 | E402I | − | ++ |

[a]Levels of increased production were determined relative to the reference polypeptide of SEQ ID NO: 20, and defined as follows: "−" = less than the activity of the reference; "+" = at least the activity of the reference but less than 1.1-fold increased production; and "++" = at least 1.1-fold increased production.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.005-0.15 g/L SFP in 100 μL total reaction volume of 50 mM potassium phosphate buffer, pH 6, 15 mM stevioside (>95% purity) or rebaudioside D, 0.02 g/L ADP (Amresco, ultra pure grade) co-substrate, 0.05 g/L SUS SFP SEQ ID NO: 18, and 37.5 mM sucrose (cane sugar). The reactions were incubated in a Thermotron® titre-plate shaker with 300 RPM shaking for 4 hours at 60° C. The reactions were solubilized by 20× dilution with water, quenched by 5× dilution with acetonitrile with 0.2% formic acid, cleared by centrifugation, and diluted 15× with water for analysis. Glycosylated products were detected by SPE-QQQ as described in Example 5, Table 5.1. A one-pot reaction was conducted with 0.01-0.3 g/L SFP in 100 μL total reaction volume of 50 mM potassium phosphate buffer, pH 6, 20 g/L RebA60, 0.02 g/L ADP (Amresco, ultra pure grade) co-substrate, 0.05 g/L SUS SFP SEQ ID NO: 18, 0.12 g/L β1,2 GT SFP SEQ ID NO: 16, and 30 g/L sucrose (cane sugar). The reactions were incubated in a THERMOTRON® titre-plate shaker with 300 RPM shaking for 16 hours at 60° C. The reactions were solubilized by 20× dilution with water, quenched by 5× dilution with acetonitrile with 0.2% formic acid, cleared by centrifugation, and diluted 20× with water for analysis. Similar one-pot reactions were also performed with 10 μL of crude shake flask lysate after diluting 20-fold in 50 mM potassium phosphate buffer, pH 6, and incubating for 24 h at 75.1° C.

TABLE 7.3

β1,3GT Shake Flask Powder Variants and RebA, RebM from RebD, and RebM from RebA60, and Thermostability Levels

| SEQ ID NO: (nt/aa) | Amino Acid Differences (Relative to SEQ ID NO: 20) | Increased RebA, 60° C.[a] | Increased RebM, 60° C.[a] | Increased RebM (from A60), 60° C.[a] | % Activity Remaining[b] |
|---|---|---|---|---|---|
| 25/26 | H81T/K139N/M144Q/H195Q/K200R/D204T/I207V/W233Q | ++ | +++ | +++ | − |
| 27/28 | H81T/Q197K/K200R/I207V/W233Q/C338A | − | + | +++ | − |
| 29/30 | A41E/T72P/C338A | ++ | ++ | ++ | − |
| 35/36 | A41E/T72P/W233Q/C338A | + | + | +++ | + |
| 47/48 | Q61D/E259T/K428I | + | + | + | − |
| 99/100 | Q61D | − | − | − | − |
| 105/106 | Q61E/Q91L/D431M | + | + | − | + |
| 113/114 | Q61D/I407T/K428I | − | + | + | − |

[a]Levels of increased production were determined relative to the reference polypeptide of SEQ ID NO: 20, at 0.019 g/L shake flask powder for single substrate and 0.04 g/L for one-pot and defined as follows: "−" = production less than that of the reference polypeptide; "+" = production at least that of the reference but less than 1.1-fold reference polypeptide; and "++" = at least 1.1-fold increased production relative to reference polypeptide.
[b]The percent of activity remaining for each variant was determined following 24 h pre-incubation at 75.1° C., relative to the production from each variant following 24 h pre-incubation at 60° C. and is defined as follows: and "−" = less than 20% of activity remained following 24 h pre-incubation at 75.1° C.; and "+" = at least 20% activity remained.

In these experiments, at least 4 variants in Table 7.3 produced more rebaudioside M from rebaudioside A 60 than SEQ ID NO: 20, and three variants also produced more rebaudioside A from stevioside and rebaudioside M from rebaudioside D. All variants were less thermostable than SEQ ID NO: 20. SEQ ID NO: 36 was selected as the starting point for further enzyme engineering, because of its superior performance in the one-pot assay and limited decrease in thermostability.

Example 8

Beta-1,3-ADP-Glycosyltransferase Variants of SEQ ID NO: 36

In this Example, experiments for evolution and screening of β1,3-glycosyltransferase (β1,3GT) polypeptides derived from SEQ ID NO: 36 for improved glucosylation of steviol glycosides using in situ synthesized ADP-glucose are described. Directed evolution of the GT encoded by SEQ ID NO: 35 (i.e., SEQ ID NO: 36) was carried out by constructing libraries of variant genes in which mutations associated with improved production identified during the development of the present invention were recombined and in which the N-terminal coding region was targeted. These libraries were then plated, grown, and screened using the high-throughput (HTP) assay described below to provide another round of 58 engineered GT variant polypeptides with glucosyltransferase activity toward ADP-glucose and steviol glycosides.

HTP Assay for Glucose Transfer from Sucrose to ADP and then from ADP-Glucose to Rebaudioside A 60

Assays were performed on 96-well plates of cleared *E. coli* culture lysates expressing SEQ ID NO: 35 (i.e., variants of SEQ ID NO: 36). Pellets were lysed, and lysate was cleared as described in Example 6, and then diluted 20× into 50 mM potassium phosphate buffer, pH 6. In order to thermally challenge the lysates, they were pre-incubated at 75° C. in a THERMOTRON® titre-plate shaker with 300 RPM shaking for 2 h. Assays were conducted with 10 μL pre-incubated lysate in 100 μL reactions and with 20 g/L rebaudioside A 60% substrate, 0.02 g/L ADP (Amresco, ultra pure grade) co-substrate, 0.03 g/L SUS SFP SEQ ID NO: 22, 0.08 g/L β-1,2-glycosyltransferase (β12GT) SEQ ID NO: 858, and 30 g/L sucrose (cane sugar). The following reaction conditions were used: 50 mM potassium phosphate buffer, pH 6, 60° C. in a THERMOTRON® titre-plate shaker with 300 RPM shaking for 16 h. Reactions were solubilized by 20× dilution with water, quenched by 5× dilution with acetonitrile with 0.2% formic acid, and diluted 20× with water for analysis. Samples were analyzed by RapidFire-MS/MS as described in Example 5, Table 5.1. Glycosyltransferase variant polypeptides that produced rebaudioside M from rebaudioside A 60 with in situ synthesized ADP-glucose at greater quantities than SEQ ID NO: 36 were identified. The engineered polypeptides are listed in Table 8.1. Four additional variants with modified N-terminal DNA coding sequences but no amino acid mutations were also identified in SEQ ID NO: 277/278, 279/280, 281/282, and 283/284. Shake-flask scale cultures were grown, lysed, cleared, and lyophilized to powder as described in Example 1 for analysis of variants shown in Table 8.2 relative to SEQ ID NO: 36.

TABLE 8.1

β1,3GT Combinatorial Variants and RebM Levels

| SEQ ID NO: (nt/aa) | Amino Acid Differences (Relative to SEQ ID NO: 36) | Increased RebM[a] |
|---|---|---|
| 169/170 | M144Q/I207V/E259T/E285S/V451Q | +++ |
| 171/172 | M144Q/S252P/E259T/A426I | +++ |
| 173/174 | H81T/S111T/M144Q/I207V/E285S/V451Q | +++ |
| 175/176 | M144Q/E285S/V451Q | +++ |
| 177/178 | M144Q/I207V/S252P/E259T | +++ |
| 179/180 | E73S/M144Q/I207V/E259T/E285S/V451Q | +++ |
| 181/182 | M144Q/I207V/V451Q | +++ |
| 183/184 | E73S/H81T/M144Q/I207V/E285S/V451Q | +++ |
| 185/186 | M144Q/S252P/E259T/A426I/V451Q | +++ |
| 187/188 | E73S/E259T/V451Q | +++ |
| 189/190 | E73S/M144Q/I207V/E259T/E285S/A426I/V451Q | +++ |
| 191/192 | H81T/M144Q/I207V/S252P/E285S/A426I | +++ |
| 193/194 | H81T/M144Q/E259T/E285S | ++ |
| 195/196 | I207V/E259T/A426I/V451Q | ++ |
| 197/198 | M144Q/E259T/E285S | ++ |
| 199/200 | M144Q/I207V/E259T | ++ |
| 201/202 | E73S/M144Q/E259T/E285S | ++ |
| 203/204 | H81T/M144Q/I207V/E259T/V451Q | ++ |
| 205/206 | M144Q/E285S | ++ |
| 207/208 | E73S/H81T/M144Q/I207V/E259T | ++ |
| 209/210 | E73S/S111T/E285S/V451Q | ++ |
| 211/212 | E73S/M144Q/I207V/S252P/A426I/V451Q | ++ |
| 213/214 | M144Q/I207V/E285S/A426I | ++ |

TABLE 8.1-continued

β1,3GT Combinatorial Variants and RebM Levels

| SEQ ID NO: (nt/aa) | Amino Acid Differences (Relative to SEQ ID NO: 36) | Increased RebM[a] |
|---|---|---|
| 215/216 | S111T/M144Q/E259T/E285S/A426I/V451Q | ++ |
| 217/218 | H81T/M144Q/E259T | ++ |
| 219/220 | H81T/M144Q/E259T/V451Q | ++ |
| 221/222 | H81T/I207V/S252P/E259T/V451Q | ++ |
| 223/224 | M144Q/I207V/E259T/A426I/V451Q | ++ |
| 225/226 | H81T/S111T/E259T/V451Q | ++ |
| 227/228 | E73S/M144Q/I207V/E259T/A426I/V451Q | + |
| 229/230 | E259T/E285S/V451Q | + |
| 231/232 | S111T/M144Q/S252P/E259T/E285S/V451Q | + |
| 233/234 | M144Q/S252P/E259T/E285S/V451Q | + |
| 235/236 | E259T | + |
| 237/238 | E285S | + |
| 239/240 | M144Q/V451Q | + |
| 241/242 | S111T/M144Q/I207V/S252P/E285S/A426I/V451Q | + |
| 243/244 | E73S/E259T/A426I/V451Q | + |
| 245/246 | M144Q/S252P/E259T/E285S | + |
| 247/248 | I207V/E285S/A426I/V451Q | + |
| 249/250 | I207V/S252P/E259T/V451Q | + |
| 251/252 | H81T/E285S | + |
| 253/254 | H81T/M144Q/S252P/E259T/E285S/V451Q | + |
| 255/256 | I207V | + |
| 257/258 | H81T/I207V/E285S/A426I/V451Q | + |
| 259/260 | I207V/S252P/V451Q | + |
| 261/262 | E285S/V451Q | + |
| 263/264 | I207V/V451Q | + |
| 265/266 | I207V/E259T | + |
| 267/268 | E73S/H81T/E259T/E285S/A426I/V451Q | + |
| 269/270 | S252P/E259T | + |
| 271/272 | H81T/E285S/V451Q | + |
| 273/274 | S111T/I207V/E285S | + |
| 275/276 | E73S/H81T/E259T/V451Q | + |

[a]Levels of increased production were determined relative to the reference polypeptide of SEQ ID NO: 36, and defined as follows: "+" = at least that of the reference but less than 1.28-fold increased production; "++" = at least 1.28-fold but less than 1.38-fold increased production relative to reference polypeptide; and "+++" = at least 1.38-fold increased production.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.005-0.15 g/L SFP in 100 μL total reaction volume of 50 mM potassium phosphate buffer, pH 6, 15 mM stevioside (>95% purity) or rebaudioside D, 0.02 g/L ADP (Amresco, ultra pure grade) co-substrate, 0.05 g/L SUS SFP SEQ ID NO: 22, and 37.5 mM sucrose (cane sugar). The reactions were incubated in a Thermotron® titre-plate shaker with 300 RPM shaking for 4 hours at 60° C. The reactions were solubilized by 20× dilution with water, quenched by 5× dilution with acetonitrile with 0.2% formic acid, cleared by centrifugation, and diluted 15× with water for analysis. Glycosylated products were detected by SPE-QQQ as described in Example 5, Table 5.1. A one-pot reaction was conducted with 0.01-0.3 g/L SFP in 100 μL total reaction volume of 50 mM potassium phosphate buffer, pH 6, 20 g/L RebA60, 0.02 g/L ADP (Amresco, ultra pure grade) co-substrate, 0.03 g/L SUS SFP SEQ ID NO: 22, 0.08 g/L β1,2 GT SFP SEQ ID NO: 858, and 30 g/L sucrose (cane sugar). The reactions were incubated in a THERMOTRON® titre-plate shaker with 300 RPM shaking for 16 hours at 60° C. The reactions were solubilized by 20× dilution with water, quenched by 5× dilution with acetonitrile with 0.2% formic acid, cleared by centrifugation, and diluted 20× with water for analysis. Similar one-pot reactions were also performed with 10 μL of crude shake flask lysate after diluting 20-fold in 50 mM potassium phosphate buffer, pH 6, and incubating for 24 h at 75.2° C.

TABLE 8.2

β1,3GT Shake Flask Powder Variants and RebA, RebM from RebD and RebM from RebA60, and Thermostability Levels

| SEQ ID NO: (nt/aa) | Amino Acid Differences (Relative to SEQ ID NO: 36) | Increased RebA[a] | Increased RebM[a] | Increased RebM (from A60)[a] | % Activity Remaining[b] |
|---|---|---|---|---|---|
| 279/280 | N/A | + | + | + | + |
| 277/279 | N/A | + | + | + | + |
| 185/186 | M144Q/S252P/E259T/A426I/V451Q | ++ | ++ | ++ | − |
| 173/174 | H81T/S111T/M144Q/I207V/E285S/V451Q | +++ | +++ | +++ | − |
| 169/107 | M144Q/I207V/E259T/E285S/V451Q | + | +++ | +++ | − |
| 171/172 | M144Q/S252P/E259T/A426I | ++ | ++ | +++ | + |
| 175/176 | M144Q/E285S/V451Q | ++ | +++ | +++ | − |
| 177/178 | M144Q/I207V/S252P/E259T | + | +++ | +++ | + |

[a]Levels of increased production were determined relative to the reference polypeptide of SEQ ID NO: 36, at 0.019 g/L shake flask powder for single substrate and 0.04 g/L for one-pot and defined as follows: "−" = production less than that of the reference polypeptide; "+" = production at least 0.92-fold that of the reference but less than 1.2-fold reference polypeptide; "++" = at least 1.2-fold increased production but less than 1.4-fold; and "+++" = at least 1.4-fold increased production relative to reference polypeptide.
[b]The percent of activity remaining for each variant was determined following 24 h pre-incubation at 75.2° C., relative to the production from each variant following 24 h pre-incubation at 65° C. and is defined as follows: "−" = less than 40% of activity remained following 24 h pre-incubation at 75.2° C.; and "+" = at least 40% activity remained.

In these experiments, the 2 N-terminally modified sequences in Table 8.2 performed the same as SEQ ID NO: 36, and the 6 combinatorial variants performed better on all three substrates. SEQ ID NO: 174 was selected as the starting point for further enzyme engineering, because of its superior performance on all three substrates.

Example 9

Beta-1,3-ADP-Glycosyltransferase Variants of SEQ ID NO: 174

In this Example, experiments for evolution and screening of β1,3-glycosyltransferase (β1,3GT) polypeptides derived from SEQ ID NO: 174 for improved glucosylation of steviol glycosides using in situ synthesized ADP-glucose are described. Directed evolution of the GT encoded by SEQ ID NO: 173 (i.e., SEQ ID NO: 174) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide another round of 60 engineered GT variant polypeptides with glucosyltransferase activity toward ADP-glucose and steviol glycosides.

HTP Assay for Glucose Transfer from Sucrose to ADP and then from ADP-Glucose to Rebaudioside A 60

Assays were performed on 96-well plates of cleared E. coli culture lysates expressing SEQ ID NO: 173 variants (i.e., variants of SEQ ID NO: 174). Pellets were lysed, and lysate was cleared as described in Example 6, and then diluted 25-33.3× into 50 mM potassium phosphate buffer, pH 6. In order to thermally challenge the lysates, they were pre-incubated at 75° C. in a THERMOTRON® titre-plate shaker with 300 RPM shaking for 2 h. Assays were conducted with 10 μL pre-incubated lysate in 100 μL reactions and with 20 g/L rebaudioside A 60% substrate, 0.02 g/L ADP (Amresco, ultra pure grade) co-substrate, 0.03 g/L SUS SFP SEQ ID NO: 1652, 0.08 g/L β-1,2-glycosyltransferase (β12GT) SEQ ID NO: 858, and 30 g/L sucrose (cane sugar). The following reaction conditions were used: 50 mM potassium phosphate buffer, pH 6, 60° C. in a THERMOTRON® titre-plate shaker with 300 RPM shaking for 16 h. Reactions were solubilized by 20× dilution with water, quenched by 5× dilution with acetonitrile with 0.2% formic acid, and diluted 20× with water for analysis. Samples were analyzed by RapidFire-MS/MS as described in Example 5, Table 5.1. Glycosyltransferase variant polypeptides that produced rebaudioside M from rebaudioside A 60 with in situ synthesized ADP-glucose at greater quantities than SEQ ID NO: 174 were identified. The engineered polypeptides are listed in Table 9.1 and Table 9.2. The saturation mutagenesis variants listed in Table 9.2 were additionally assayed under 4 more conditions. One was the same as the assay described above, except incubated for 16 h at 70° C. Another was the same as above, except 40 g/L RebA60 was included in the pre-incubation potassium phosphate dilution buffer. The other two were single substrate reaction conditions in which clarified lysate was diluted 25× into 50 mM potassium phosphate buffer, pH 6, pre-incubated at 75° C. for 2 h, and then diluted 10× into 100 μL reactions containing 15 mM steviol glycoside 95% or rebaudioside D, 30 g/L sucrose, 0.02 g/L ADP, 50 mM potassium phosphate pH 6, and 0.03 g/L SUS SFP SEQ ID NO: 1652. These reactions were incubated for 16 h at 60° C., solubilized by diluting 20× in water, quenched by diluting 5× into acetonitrile with 0.2% formic acid, and precipitated by cold centrifugation. The supernatants were then diluted 15× in water and analyzed by RapidFire-MS/MS. Shake-flask scale cultures were grown, lysed, cleared, and lyophilized to powder as described in Example 1 for analysis of variants shown in Table 9.3 relative to SEQ ID NO: 174.

TABLE 9.1

β1,3GT Combinatorial Variants and RebM Levels

| SEQ ID NO: (nt/aa) | Amino Acid Differences (Relative to SEQ ID NO: 174) | Increased RebM[a] |
|---|---|---|
| 285/286 | T80D/A85V/A251I/E259T | +++ |
| 287/288 | A85V | +++ |
| 289/290 | T80P/A85V | +++ |
| 291/292 | A85V/A251M/S252P/L256G | +++ |
| 293/294 | T80D/T81A/A85V | +++ |
| 295/296 | T80D/T81A/A85V/A238G | +++ |
| 297/298 | T80P/T81A/A85V/E259T | ++ |
| 299/300 | T80D/A85V/A251I/S252P/L256G/E259T | ++ |
| 301/302 | T80D/A85V/E259T | ++ |
| 303/304 | A85V/A238G | ++ |
| 305/306 | T81A/A85V/E259T | ++ |
| 307/308 | T80D/A85V | ++ |
| 309/310 | T80D/A85V/A251M | ++ |
| 311/312 | T80P/T81A/A251I/S252P/E259T | ++ |
| 313/314 | T80D/A85V/A238G | ++ |
| 315/316 | T80D/A85V/A251M/S252P | ++ |
| 317/318 | T81A/A85V | + |
| 319/320 | T81A/A85V/A251M/S252P | + |
| 321/322 | T80D/A85V/A251M/S252P/L256G/E259T | + |
| 323/324 | T80P/A85V/A251M/S252P/E259T | + |
| 325/326 | T80D/E259T | + |
| 327/328 | T80D/T81A/A85V/A251M/E259T | + |
| 329/330 | E259T | + |
| 331/332 | Q270K/E402I | + |
| 333/334 | A85V/A251F | + |
| 335/336 | A251I/S252P/E259T | + |
| 337/338 | T80D/T81A | + |
| 339/340 | E420R | + |
| 341/342 | T80D/A85V/A238G/A251M/E259T | + |
| 343/344 | A85V/L256G/E259T | + |
| 345/346 | T80D/T81A/A85V/S252P/L256G/E259T | + |
| 347/348 | A85V/A251F/E259T | + |
| 349/350 | E175D/E402I | + |

[a]Levels of increased production were determined relative to the reference polypeptide of SEQ ID NO: 174, and defined as follows: "+" = at least 1.12-fold that of the reference but less than 1.21-fold increased production; "++" = at least 1.21-fold but less than 1.24-fold increased production relative to reference polypeptide; and "+++" = at least 1.24-fold increased production.

TABLE 9.2

β1,3GT Saturation Mutagenesis Variants and RebM Levels

| SEQ ID NO: (nt/aa) | Amino Acid Differences (Relative to SEQ ID NO: 174) | Increased RebA[a] | Increased RebM[a] | Increased RebM (from A60, 60° C.)[a] | Increased RebM (from A60, 70° C.)[a] | Increased RebM (from A60, A60 preincubated)[a] |
|---|---|---|---|---|---|---|
| 351/352 | G326E | ++ | ++ | +++ | ++ | +++ |
| 353/354 | G404V | ++ | ++ | +++ | +++ | +++ |
| 355/356 | S443A | ++ | ++ | +++ | ++ | + |
| 357/358 | S5L | +++ | ++ | +++ | +++ | ++ |
| 359/360 | G326A | ++ | ++ | +++ | ++ | ++ |
| 361/362 | N3S | ++ | + | ++ | ++ | +++ |
| 363/364 | S5T | ++ | + | ++ | + | ++ |
| 365/366 | M422I | + | ++ | ++ | ++ | ++ |
| 367/368 | S455M | ++ | + | ++ | ++ | ++ |
| 369/370 | T7A | ++ | + | ++ | + | ++ |
| 371/372 | V299M | + | + | ++ | − | − |
| 373/374 | G404M | + | ++ | ++ | ++ | ++ |
| 375/376 | G326S | ++ | + | ++ | ++ | + |
| 377/378 | V232I/Y317L | − | + | ++ | − | ++ |
| 379/380 | G326N | ++ | + | ++ | + | + |
| 381/382 | V393I | + | − | ++ | + | + |
| 383/384 | S5A | ++ | + | ++ | ++ | ++ |
| 385/386 | A153C | + | + | + | ++ | ++ |
| 387/388 | S5H | ++ | + | + | + | + |
| 389/390 | T7Q | + | + | + | + | + |
| 391/392 | A409S | ++ | + | + | + | − |
| 393/394 | Q451V | + | − | + | + | + |
| 395/396 | S455R | + | + | + | +++ | + |
| 397/398 | Q451E | + | + | + | + | − |
| 399/400 | E99V | − | − | + | + | + |
| 401/402 | S252A | − | + | + | − | + |
| 403/404 | S273K | + | + | + | + | + |

[a]Levels of increased production were determined relative to the reference polypeptide of SEQ ID NO: 174, and defined as follows: "−" = production less than that of the reference polypeptide, "+" = at least that of the reference but less than 1.1-fold increased production; "++" = at least 1.1-fold that of the reference but less than 1.2-fold; and "+++" at least 1.2-fold increased production relative to the reference.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.005-0.15 g/L SFP in 100 µL total reaction volume of 50 mM potassium phosphate buffer, pH 6, 15 mM stevioside (>95% purity) or rebaudioside D, 0.02 g/L ADP (Amresco, ultra pure grade) co-substrate, 0.03 g/L SUS SFP SEQ ID NO: 1652, and 37.5 mM sucrose (cane sugar). The reactions were incubated in a THERMOTRON® titre-plate shaker with 300 RPM shaking for 4 hours at 60° C. The reactions were solubilized by 20× dilution with water, quenched by 5× dilution with acetonitrile with 0.2% formic acid, cleared by centrifugation, and diluted 15× with water for analysis. Glycosylated products were detected by SPE-QQQ as described in Example 5, Table 5.1. A one-pot reaction was conducted with 0.01-0.3 g/L SFP in 100 µL total reaction volume of 50 mM potassium phosphate buffer, pH 6, 20 g/L RebA60, 0.02 g/L ADP (Amresco, ultra pure grade) co-substrate, 0.03 g/L SUS SFP SEQ ID NO: 1652, 0.08 g/L β1,2 GT SFP SEQ ID NO: 858, and 30 g/L sucrose (cane sugar). The reactions were incubated in a THERMOTRON® titre-plate shaker with 300 RPM shaking for 16 hours at 60° C. The reactions were solubilized by 20× dilution with water, quenched by 5× dilution with acetonitrile with 0.2% formic acid, cleared by centrifugation, and diluted 20× with water for analysis Similar one-pot reactions were also performed with 10 µL of crude shake flask lysate after diluting 20-fold in 50 mM potassium phosphate buffer, pH 6, and incubating for 24 h at 75.2° C.

Example 10

Beta-1,3-ADP-Glycosyltransferase Variants of SEQ ID NO: 406

In this Example, experiments for evolution and screening of β1,3-glycosyltransferase (β1,3GT) polypeptides derived from SEQ ID NO: 406 for improved glucosylation of steviol glycosides using in situ synthesized ADP-glucose are described. Directed evolution of the GT encoded by SEQ ID NO: 405 (i.e., SEQ ID NO: 406) was carried out by constructing libraries of variant genes in which mutations associated with improved production identified during the development of the present invention were recombined. These libraries were then plated, grown, and screened using the high-throughput (HTP) assay described below to provide another round of 16 engineered GT variant polypeptides with glucosyltransferase activity toward ADP-glucose and steviol glycosides.

HTP Assay for Glucose Transfer from Sucrose to ADP and then from ADP-Glucose to Rebaudioside A 60

Assays were performed on 96-well plates of cleared *E. coli* culture lysates expressing SEQ ID NO: 405 variants (i.e., variants of SEQ ID NO: 406). Pellets were lysed, and lysate was cleared as described in Example 6, and then diluted 15× into 50 mM potassium phosphate buffer, pH 6 and separately the same buffer with 40 g/L rebaudioside A 60% substrate. In order to thermally challenge the lysates, they were pre-incubated at 75° C. in a THERMOTRON® titre-plate shaker with 300 RPM shaking for 2 h. Assays were conducted with 10 µL pre-incubated lysate in 100 µL

TABLE 9.3

β1,3GT Shake Flask Powder Variants and RebA, RebM from RebD, and RebM from RebA60, and Thermostability Levels

| SEQ ID NO: (nt/aa) | Amino Acid Differences (Relative to SEQ ID NO: 174) | Increased RebA, 60° C.[a] | Increased RebM, 60° C.[a] | Increased RebM (from A60), 60° C.[a] | % Activity Remaining[b] |
|---|---|---|---|---|---|
| 287/288 | A85V | ++ | ++ | +++ | ++ |
| 285/286 | T80D/A85V/A251I/E259T | ++ | ++ | +++ | +++ |
| 291/292 | A85V/A251M/S252P/L256G | − | ++ | +++ | − |
| 293/294 | T80D/T81A/A85V | + | + | +++ | + |
| 289/290 | T80P/A85V | ++ | − | ++ | ++ |
| 349/350 | E175D/E402I | + | − | − | +++ |
| 331/332 | Q270K/E402I | − | − | − | − |

[a]Levels of increased production were determined relative to the reference polypeptide of SEQ ID NO: 174, at 0.019 g/L shake flask powder for single substrate and 0.04 g/L for one-pot and defined as follows: "−" = production less than that of the reference polypeptide; "+" = production at least that of the reference but less than 1.1-fold reference polypeptide; "++" = at least 1.1-fold increased production but less than 1.2-fold; and "+++" = at least 1.2-fold increased production relative to reference polypeptide.

[b]The percent of activity remaining for each variant was determined following 24 h pre-incubation at 75.2° C., relative to the production from each variant following 24 h pre-incubation at 65° C. and is defined as follows: "−" = less than 20% of activity remained following 24 h pre-incubation at 75.2° C.; "+" = at least 20% activity remained, but less than 30% activity remaining; "++" = at least 30% activity remained, but less than 40% activity remaining; and "+++" = at least 40% activity remained.

In these experiments, five variants in Table 9.3 produced more rebaudioside M from rebaudioside A 60 than SEQ ID NO: 174, and four variants also produced more rebaudioside A from stevioside and of those three also produced more rebaudioside M from rebaudioside D. Several variants were significantly more thermostable than SEQ ID NO: 190. The most thermostable variant, SEQ ID NO: 350, was re-cloned with the best N-terminal DNA sequence from Example 8 (SEQ ID NO: 279/280) and this enzyme, SEQ ID NO: 406, was used as the starting point for further enzyme engineering.

reactions and with 20 g/L rebaudioside A 60% substrate, 0.02 g/L ADP (Amresco, ultra pure grade) co-substrate, 0.03 g/L SUS SFP SEQ ID NO: 1822, 0.06 g/L β-1,2-glycosyltransferase (β12GT) SEQ ID NO: 994, and 30 g/L sucrose (cane sugar). The following reaction conditions were used: 50 mM potassium phosphate buffer, pH 6, 60° C. in a THERMOTRON® titre-plate shaker with 300 RPM shaking for 16 h. Reactions were solubilized by 20× dilution with water, quenched by 5× dilution with acetonitrile with 0.2% formic acid, and diluted 20× with water for analysis. Samples were analyzed by RapidFire-MS/MS as described in Example 5, Table 5.1. Glycosyltransferase variant polypeptides that produced rebaudioside M from rebaudioside A 60 with in situ synthesized ADP-glucose at greater quantities than SEQ ID NO: 406 were identified. The engineered polypeptides are listed in Table 10.1.

TABLE 10.1

β1,3 GT Combinatorial Variants and RebM Levels

| SEQ ID NO: (nt/aa) | Amino Acid Differences (Relative to SEQ ID NO: 406) | Increased RebM[a] | Increased RebM (A60 preincubated)[a] |
|---|---|---|---|
| 407/408 | A85V/E259T | ++ | ++ |
| 409/410 | A85V/D175E/E259T | ++ | +++ |
| 411/412 | A85V/D175E/A251I/E259T/I402E | ++ | ++ |
| 413/414 | A85V | ++ | ++ |
| 415/416 | A85V/D175E/E259T/I402E | ++ | +++ |
| 417/418 | A85V/D175E/I402E | ++ | + |
| 419/420 | T81A/A85V/A251I/E259T | ++ | ++ |
| 421/422 | T81A/A85V/A251I | ++ | ++ |
| 423/424 | T81A/A85V/E259T/I402E | ++ | ++ |
| 425/426 | T81A/A85V/D175E/E259T/I402E | ++ | + |
| 427/428 | A85V/I402E | ++ | ++ |
| 429/430 | A85V/E259T/I402E | ++ | ++ |
| 431/432 | T81A/A85V | ++ | ++ |
| 433/434 | A85V/D175E | ++ | ++ |
| 435/436 | A85V/D175E/A251I | + | ++ |
| 437/438 | T81A/A85V/E259T | + | ++ |

[a]Levels of increased production were determined relative to the reference polypeptide of SEQ ID NO: 406, and defined as follows: "+" = at least 1.1-fold that of the reference but less than 1.25-fold increased production; "++" = at least 1.25-fold but less than 1.5-fold increased production relative to reference polypeptide; and "+++" = at least 1.5-fold increased production.

From the variants listed in Table 10.1, SEQ ID NO: 408 was selected on the basis of the improvement in stability to pre-incubation in potassium phosphate buffer with and without rebaudioside A 60% and the benefit associated with the two mutations A85V and E259T as the starting point for further enzyme engineering.

Example 11

Beta-1,3-ADP-Glycosyltransferase Variants of SEQ ID NO: 408

In this Example, experiments for evolution and screening of β1,3-glycosyltransferase (β1,3GT) polypeptides derived from SEQ ID NO: 408 for improved glucosylation of steviol glycosides using in situ synthesized ADP-glucose are described. Directed evolution of the GT encoded by SEQ ID NO: 407 (i.e., SEQ ID NO: 408) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide another round of 39 engineered GT variant polypeptides with glucosyltransferase activity toward ADP-glucose and steviol glycosides.

HTP Assay for Glucose Transfer from Sucrose to ADP and then from ADP-Glucose to Rebaudioside A 60

Assays were performed on 96-well plates of cleared *E. coli* culture lysates expressing SEQ ID NO: 407 variants (i.e., variants of SEQ ID NO: 408). Pellets were lysed, and lysate was cleared as described in Example 6, and then diluted 20× into 50 mM potassium phosphate buffer, pH 6 with 60 g/L of rebaudioside A 60%. In order to thermally challenge the lysates, they were pre-incubated at 75° C. in a THERMOTRON® titre-plate shaker with 300 RPM shaking for 2 h. Assays were conducted with 10 μL pre-incubated lysate in 100 μL reactions and with 20 g/L rebaudioside A 60% substrate, 0.02 g/L ADP (Amresco, ultra pure grade) co-substrate, 0.03 g/L SUS SFP SEQ ID NO: 1822, 0.06 g/L β-1,2-glycosyltransferase (β12GT) SEQ ID NO: 1080, and 30 g/L sucrose (cane sugar). The following reaction conditions were used: 50 mM potassium phosphate buffer, pH 6, 60° C. in a THERMOTRON® titre-plate shaker with 300 RPM shaking for 16 h. Reactions were solubilized by 20× dilution with water, quenched by 5× dilution with acetonitrile with 0.2% formic acid, and diluted 20× with water for analysis. Samples were analyzed by RapidFire-MS/MS as described in Example 5, Table 5.1. Glycosyltransferase variant polypeptides that produced rebaudioside M from rebaudioside A 60 with in situ synthesized ADP-glucose at greater quantities than SEQ ID NO: 408 were identified. The engineered polypeptides are listed in Table 11.1 and Table 11.2. Shake-flask scale cultures were grown, lysed, cleared, and lyophilized to powder as described in Example 1 for analysis of variants shown in Table 11.3 relative to SEQ ID NO: 408.

TABLE 11.1

β1,3GT Combinatorial Variants and RebM Levels

| SEQ ID NO: (nt/aa) | Amino Acid Differences (Relative to SEQ ID NO: 408) | Increased RebM[a] |
|---|---|---|
| 439/440 | A153C | +++ |
| 441/442 | A153C/G326S/S443A | ++ |
| 443/444 | A153C/G326S | ++ |
| 445/446 | V232I/V393I/Q451E | ++ |
| 447/448 | G326E | ++ |
| 449/450 | V232I | + |
| 451/452 | G404V | + |
| 453/454 | A153C/G326S/S443A/S455M | + |
| 455/456 | G326S | + |
| 457/458 | Q451E | + |
| 459/460 | V232I/S273K/V299M | + |
| 461/462 | V299M/Q451E | + |

[a]Levels of increased production were determined relative to the reference polypeptide of SEQ ID NO: 408, and defined as follows: "+" = at least 1.1-fold that of the reference but less than 1.15-fold increased production; "++" = at least 1.15-fold but less than 1.3-fold increased production relative to reference polypeptide; and "+++" = at least 1.3-fold increased production.

TABLE 11.2

β1,3GT Saturation Mutagenesis Variants and RebM Levels

| SEQ ID NO: (nt/aa) | Amino Acid Differences (Relative to SEQ ID NO: 408) | Increased RebM[a] |
|---|---|---|
| 463/464 | D170P | +++ |
| 465/466 | D170G | +++ |
| 467/468 | A300S | +++ |
| 469/470 | S146G | +++ |
| 471/472 | R412A | +++ |
| 473/474 | D170C | ++ |
| 475/476 | E116R | ++ |
| 477/478 | D170T | ++ |
| 479/480 | D170S | ++ |
| 481/482 | R412K | ++ |
| 483/484 | S227T | ++ |
| 485/486 | A438Q | ++ |
| 487/488 | E330T | ++ |
| 489/490 | K315T | + |
| 491/492 | E448H | + |
| 493/494 | N408C | + |
| 495/496 | T361C | + |
| 497/498 | E330G | + |

TABLE 11.2-continued

β1,3GT Saturation Mutagenesis Variants and RebM Levels

| SEQ ID NO: (nt/aa) | Amino Acid Differences (Relative to SEQ ID NO: 408) | Increased RebM[a] |
|---|---|---|
| 499/500 | R296V | + |
| 501/502 | E116D | + |
| 503/504 | F327Y | + |
| 505/506 | R449S | + |
| 507/508 | R173S | + |
| 509/510 | L25A | + | dilutions was pre-incubated at 75° C. for 2 h in 50 mM potassium phosphate buffer, pH 6, while another set was not preincubated. The reactions were incubated in a THERMOTRON® titre-plate shaker with 300 RPM shaking for 16 hours at 60° C. The reactions were solubilized by 20× dilution with water, quenched by 5× dilution with acetonitrile with 0.2% formic acid, cleared by centrifugation, and diluted 20× with water for analysis Similar one-pot reactions were also performed with 10 μL of crude shake flask lysate after diluting 20-fold in 50 mM potassium phosphate buffer, pH 6, and incubating for 24 h at 75.2° C.

TABLE 11.3

β1,3GT Shake Flask Powder Variants and RebA, RebM from RebD, and RebM from RebA60, and Thermostability Levels

| SEQ ID NO: (nt/aa) | Amino Acid Differences (Relative to SEQ ID NO: 408) | Increased RebA[a] | Increased RebM[a] | Increased RebM (from A60)[a] | Increased RebM (from A60, A60 preincubated)[a] | % Activity Remaining[b] |
|---|---|---|---|---|---|---|
| 439/440 | A153C | ++ | ++ | + | + | ++ |
| 449/450 | V232I | ++ | + | + | ++ | + |
| 445/446 | V232I/V393I/Q451E | +++ | + | ++ | ++ | − |
| 457/458 | Q451E | +++ | + | + | + | − |

[a]Levels of increased production were determined relative to the reference polypeptide of SEQ ID NO: 408, at 0.009 g/L shake flask powder for single substrate and 0.02 g/L for one-pot and defined as follows: "+" = production less than 1.1-fold that of the reference; "++" = production at least 1.1-fold of the reference but less than 1.25-fold reference polypeptide; and "+++" = at least 1.25-fold increased production relative to reference polypeptide.
[b]The percent of activity remaining for each variant was determined following 24 h pre-incubation at 75.2° C., relative to the production from each variant following 24 h pre-incubation at 65° C. and is defined as follows: "−" = less than 30% of activity remained following 24 h pre-incubation at 75.2° C.; "+" = at least 30% activity remained, but there was less than 50% activity remaining; and "++" = at least 50% activity remained.

TABLE 11.2-continued

β1,3GT Saturation Mutagenesis Variants and RebM Levels

| SEQ ID NO: (nt/aa) | Amino Acid Differences (Relative to SEQ ID NO: 408) | Increased RebM[a] |
|---|---|---|
| 511/512 | R412S | + |
| 513/514 | E116S | + |
| 515/516 | N408T | + |

[a]Levels of increased production were determined relative to the reference polypeptide of SEQ ID NO: 408, and defined as follows: "+" = at least 1.10-fold that of the reference but less than 1.14-fold increased production; "++" = at least 1.14-fold but less than 1.19-fold increased production; and "+++" = greater than 1.19-fold increased production.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.005-0.15 g/L SFP in 100 μL total reaction volume of 50 mM potassium phosphate buffer, pH 6, 15 mM stevioside (>95% purity) or rebaudioside D, 0.02 g/L ADP (Amresco, ultra pure grade) co-substrate, 0.03 g/L SUS SFP SEQ ID NO: 1822, and 37.5 mM sucrose (cane sugar). The reactions were incubated in a THERMOTRON® titre-plate shaker with 300 RPM shaking for 4 hours at 60° C. The reactions were solubilized by 20× dilution with water, quenched by 5× dilution with acetonitrile with 0.2% formic acid, cleared by centrifugation, and diluted 15× with water for analysis. Glycosylated products were detected by SPE-QQQ as described in Example 5, Table 5.1. A one-pot reaction was conducted with 0.01-0.3 g/L SFP in 100 μL total reaction volume of 50 mM potassium phosphate buffer, pH 6, 20 g/L RebA60, 0.02 g/L ADP (Amresco, ultra pure grade) co-substrate, 0.03 g/L SUS SFP SEQ ID NO: 1822, 0.06 g/L β1,2 GT SFP SEQ ID NO: 1080, and 30 g/L sucrose (cane sugar). One set of SFP In these experiments, all four variants in Table 11.3 produced more rebaudioside M from rebaudioside A 60 than SEQ ID NO: 408, more rebaudioside A from stevioside, and more rebaudioside M from rebaudioside D. The most thermostable variant, SEQ ID NO: 440, was used as the starting point for further enzyme engineering.

Example 12

Beta-1,3-ADP-Glycosyltransferase Variants of SEQ ID NO: 440

In this Example, experiments for evolution and screening of β1,3-glycosyltransferase (β1,3GT) polypeptides derived from SEQ ID NO: 440 for improved glucosylation of steviol glycosides using in situ synthesized ADP-glucose are described. Directed evolution of the GT encoded by SEQ ID NO: 439 (i.e., SEQ ID NO: 440) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide another round of 36 engineered GT variant polypeptides with glucosyltransferase activity toward ADP-glucose and steviol glycosides.

HTP Assay for Glucose Transfer from Sucrose to ADP and then from ADP-Glucose to Rebaudioside A 60

Assays were performed on 96-well plates of cleared E. coli culture lysates expressing SEQ ID NO: 440 variants. Pellets were lysed, and lysate was cleared as described in Example 6, and then diluted 20× into 50 mM potassium phosphate buffer, pH 6 with 80 g/L of rebaudioside A 60%.

In order to thermally challenge the lysates, they were pre-incubated at 75° C. in a THERMOTRON® titre-plate shaker with 300 RPM shaking for 2 h. Assays were conducted with 10 µL pre-incubated lysate in 100 µL reactions and with 20 g/L rebaudioside A 60% substrate, 0.02 g/L ADP (Amresco, ultra pure grade) co-substrate, 0.03 g/L SUS SFP SEQ ID NO: 1822, 0.06 g/L β-1,2-glycosyltransferase (β12GT) SEQ ID NO: 1080, and 30 g/L sucrose (cane sugar). The following reaction conditions were used: 50 mM potassium phosphate buffer, pH 6, 60° C. in a THERMOTRON® titre-plate shaker with 300 RPM shaking for 16 h. Reactions were solubilized by 20× dilution with water, quenched by 5× dilution with acetonitrile with 0.2% formic acid, and diluted 20× with water for analysis. Samples were analyzed by RapidFire-MS/MS as described in Example 5, Table 5.1. Glycosyltransferase variant polypeptides that produced rebaudioside M from rebaudioside A 60 with in situ synthesized ADP-glucose at greater quantities than SEQ ID NO: 440 were identified. The engineered polypeptides are listed in Table 12.1 and Table 12.2. Shake-flask scale cultures were grown, lysed, cleared, and lyophilized to powder as described in Example 1 for analysis of variants shown in Table 12.3 relative to SEQ ID NO: 440.

TABLE 12.1

β1,3 GT Combinatorial Variants and RebM Levels

| SEQ ID NO: (nt/aa) | Amino Acid Differences (Relative to SEQ ID NO: 440) | Increased RebM[a] |
|---|---|---|
| 517/518 | S146G/D170S/V232I | +++ |
| 519/520 | S146G/D170T/W196I/V232I | +++ |
| 521/522 | S146G/D170S/V232I/R423K/ E448H/Q451E/S455M | +++ |
| 523/524 | S146G/W196I/V232I | +++ |
| 525/526 | S146G/W196I/V232I/T259E/E448H/ Q451E | ++ |
| 527/528 | S146G/D170T/W196I/V232I/Q451E/ S455R | ++ |
| 529/530 | S146G/D170T/V232I/R423K | ++ |
| 531/532 | S146G/V232I/K315S/R423K/Q451E/ S455M | ++ |
| 533/534 | S146G/V232I/G326E | ++ |
| 535/536 | S146G/D170T/W196I/V232I/R423K | ++ |
| 537/538 | S146G/D170S/W196I | + |
| 539/540 | S146G/V232I/Q451E | + |
| 541/542 | S146G/V232I/E448H | + |
| 543/544 | S146G/W196I | + |
| 545/546 | S146G/V413M/Q451E/S455M | + |
| 547/548 | S146G/V232I/K315S | + |
| 549/550 | S146G/D170T/T259E | + |
| 551/552 | S146G/V232I/T259E/S455M | + |
| 553/554 | S146G/W196I/S455R | + |
| 555/556 | S146G/D170T/W196I/N408T/Q451E | + |

[a]Levels of increased production were determined relative to the reference polypeptide of SEQ ID NO: 440, and defined as follows: "+" = at least 1.36-fold that of the reference but less than 1.52-fold increased production; "++" = at least 1.52-fold but less than 1.65-fold increased production relative to reference polypeptide; and "+++" = at least 1.65-fold increased production.

TABLE 12.2

β1,3GT Saturation Mutagenesis Variants and RebM Levels

| SEQ ID NO: (nt/aa) | Amino Acid Differences (Relative to SEQ ID NO: 440) | Increased RebM[a] |
|---|---|---|
| 557/558 | E209Y | +++ |
| 559/560 | D204M | +++ |
| 561/562 | A107C | +++ |
| 563/564 | K289A | ++ |
| 565/566 | L161E | ++ |
| 567/568 | V9L | ++ |
| 569/570 | R12Q | ++ |
| 571/572 | P417V | ++ |
| 573/574 | E169T | + |
| 575/576 | S337W | + |
| 577/578 | C156S | + |
| 579/580 | P131A | + |
| 581/582 | S337N | + |
| 583/584 | A199S | + |
| 585/586 | Q233K | + |
| 587/588 | S262A | + |

[a]Levels of increased production were determined relative to the reference polypeptide of SEQ ID NO: 440, and defined as follows: "+" = at least 1.07-fold that of the reference but less than 1.12-fold increased production; "++" = at least 1.12-fold that of the reference but less than 1.16-fold increased production; and "+++" = at least 1.16-fold increased production.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.005-0.15 g/L SFP in 100 µL total reaction volume of 50 mM potassium phosphate buffer, pH 6, 15 mM stevioside (>95% purity) or rebaudioside D, 0.02 g/L ADP (Amresco, ultra pure grade) co-substrate, 0.03 g/L SUS SFP SEQ ID NO: 1822, and 37.5 mM sucrose (cane sugar). The reactions were incubated in a Thermotron® titre-plate shaker with 300 RPM shaking for 4 hours at 60° C. The reactions were solubilized by 20× dilution with water, quenched by 5× dilution with acetonitrile with 0.2% formic acid, cleared by centrifugation, and diluted 15× with water for analysis. Glycosylated products were detected by SPE-QQQ as described in Example 5, Table 5.1. A one-pot reaction was conducted with 0.01-0.3 g/L SFP in 100 µL total reaction volume of 50 mM potassium phosphate buffer, pH 6, 20 g/L RebA60, 0.02 g/L ADP (Amresco, ultra pure grade) co-substrate, 0.03 g/L SUS SFP SEQ ID NO: 1822, 0.06 g/L β1,2GT SFP SEQ ID NO: 1080, and 30 g/L sucrose (cane sugar). One set of SFP dilutions was pre-incubated at 75° C. for 2 h in 50 mM potassium phosphate buffer, pH 6 with 80 g/L rebaudioside A 60%, while another set was not preincubated. The reactions were incubated in a THERMOTRON® titre-plate shaker with 300 RPM shaking for 16 hours at 60° C. The reactions were solubilized by 20× dilution with water, quenched by 5× dilution with acetonitrile with 0.2% formic acid, cleared by centrifugation, and diluted 20× with water for analysis Similar one-pot reactions were also performed with 10 µL of 1.5 mg/mL shake flask powder in 50 mM potassium phosphate buffer, pH 6, that had been incubated 24 h at 78.5° C.

TABLE 12.3

β1,3 GT Shake Flask Powder Variants and RebA, RebM from RebD, and RebM from RebA60, and Thermostability Levels

| SEQ ID NO: (nt/aa) | Amino Acid Differences (Relative to SEQ ID NO: 440) | Increased RebA[a] | Increased RebM[a] | Increased RebM (from A60)[a] | Increased RebM (from A60, A60 preincubated)[a] | % Activity Remaining[b] |
|---|---|---|---|---|---|---|
| 541/542 | S146G/V232I/E448H | − | + | + | + | − |
| 537/538 | S146G/D170S/W196I | − | + | +++ | ++ | − |
| 523/524 | S146G/W196I/V232I | − | + | +++ | ++ | − |
| 525/526 | S146G/W196I/V232I/T259E/E448H/Q451E | − | + | ++ | + | − |
| 527/528 | S146G/D170T/W196I/V232I/Q451E/S455R | − | ++ | +++ | +++ | ++ |
| 519/520 | S146G/D170T/W196I/V232I | − | ++ | +++ | +++ | − |
| 517/518 | S146G/D170S/V232I | − | ++ | ++ | ++ | + |
| 521/522 | S146G/D170S/V232I/R423K/E448H/Q451E/S455M | − | ++ | ++ | ++ | − |

[a]Levels of increased production were determined relative to the reference polypeptide of SEQ ID NO: 440, at 0.009 g/L shake flask powder for single substrate and 0.02 g/L for one-pot and defined as follows: "−" = production less than 0.9-fold that of the reference polypeptide; "+" = production at least 0.9-fold that of the reference but less than 1.25-fold reference polypeptide; "++" = at least 1.25-fold increased production but less than 1.5-fold; and "+++" = at least 1.5-fold increased production relative to reference polypeptide.

[b]The percent of activity remaining for each variant was determined following 24 h pre-incubation at 78.5° C., relative to the production from each variant following 24 h pre-incubation at 65° C. and is defined as follows: "−" = less than 50% of activity remained following 24 h pre-incubation at 78.5° C.; "+" = at least 50% activity remained, but less than 60% activity remaining; and "++" = at least 60% activity remained.

In these experiments, all eight variants in Table 12.3 produced more rebaudioside M from rebaudioside A 60 and from rebaudioside D than SEQ ID NO: 440. All of the variants were also less active in catalyzing glucosylation of stevioside to form rebaudioside A. The variant with the most activity on all three substrates, SEQ ID NO: 520, was used as the starting point for further enzyme engineering.

Example 13

Beta-1,3-ADP-Glycosyltransferase Variants of SEQ ID NO: 520

In this Example, experiments for evolution and screening of β1,3-glycosyltransferase (β1,3GT) polypeptides derived from SEQ ID NO: 520 for improved glucosylation of steviol glycosides using in situ synthesized ADP-glucose are described. Directed evolution of the GT encoded by SEQ ID NO: 519 (i.e., SEQ ID NO: 520) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide another round of 44 engineered GT variant polypeptides with glucosyltransferase activity toward ADP-glucose and steviol glycosides.

HTP Assay for Glucose Transfer from Sucrose to ADP and then from ADP-Glucose to Rebaudioside A 60

Assays were performed on 96-well plates of cleared E. coli culture lysates expressing SEQ ID NO: 519 variants (i.e., variants of SEQ ID NO 520). Pellets were lysed, and lysate was cleared as described in Example 6, and then diluted 49× into 50 mM potassium phosphate buffer, pH 6 with 100 g/L of rebaudioside A 60%. In order to thermally challenge the lysates, they were pre-incubated at 75° C. in a THERMOTRON® titre-plate shaker with 300 RPM shaking for 2 h. Assays were conducted with 10 μL pre-incubated lysate in 100 μL reactions and with 40 g/L rebaudioside A 60% substrate, 0.02 g/L ADP (Amresco, ultra pure grade) co-substrate, 0.06 g/L SUS SFP SEQ ID NO: 2182, 0.12 g/L β-1,2-glycosyltransferase (β12GT) SEQ ID NO: 1216, and 60 g/L sucrose (cane sugar). The following reaction conditions were used: 50 mM potassium phosphate buffer, pH 6, 60° C. in a THERMOTRON® titre-plate shaker with 300 RPM shaking for 16 h. Reactions were solubilized by 40× dilution with water, quenched by 5× dilution with acetonitrile with 0.2% formic acid, and diluted 20× with water for analysis. Samples were analyzed by RapidFire-MS/MS as described in Example 5, Table 5.1. Glycosyltransferase variant polypeptides that produced rebaudioside M from rebaudioside A 60 with in situ synthesized ADP-glucose at greater quantities than SEQ ID NO: 520 were identified. The engineered polypeptides are listed in Table 13.1 and Table 13.2. Shake-flask scale cultures were grown, lysed, cleared, and lyophilized to powder as described in Example 1 for analysis of variants shown in Table 13.3 relative to SEQ ID NO: 520.

TABLE 13.1

β1,3GT Combinatorial Variants and RebM Levels

| SEQ ID NO: (nt/aa) | Amino Acid Differences (Relative to SEQ ID NO: 520) | Increased RebM[a] |
|---|---|---|
| 589/590 | D204M/Q451E/S455R | +++ |
| 591/592 | V9L/R12Q/A199S/D204M/E209Y/S337N/S455R | +++ |
| 593/594 | V9L/D204M | +++ |
| 595/596 | L161E/D204M/P417V | +++ |
| 597/598 | V9L/D204M/T259E/K289A | +++ |
| 599/600 | V9L/R12Q/L161E/E169T/A199S/E209Y/S337W | ++ |
| 601/602 | V9L/A107C/C156S/L161E/A199S/D204M/P417V/S455R | ++ |
| 603/604 | A107C/A199S/E209Y/T259E/Q451E/S455R | ++ |
| 605/606 | Q451E/S455R | ++ |
| 607/608 | V9L/E169T/D204M/K289A/S337W/Q451E/S455R | ++ |
| 609/610 | V9L/P131A/C156S/E209Y/K289A/S337N | ++ |
| 611/612 | V9L/R12Q/A107C/L161E/A199S/E209Y/S337N | ++ |
| 613/614 | C156S/E169T/A199S/D204M/E209Y/T259E/K289A | ++ |
| 615/616 | K289A | + |
| 617/618 | R12Q/V14I/A107C/D204M/K289A/S455R | + |
| 619/620 | V9L/A107C/L161E/E209Y/T259E/K289A/Q451E/S455R | + |
| 621/622 | V9L/P131A/D204M/S337N/Q451E | + |
| 623/624 | V9L/S337W | + |
| 625/626 | A107C/A199S/D204M/K289A | + |
| 627/628 | R12Q/A107C/C156S/E209Y/K289A/S455R | + |
| 629/630 | V9L/R12Q/A199S/E209Y/S337W/Q451E/S455R | + |
| 631/632 | V9L/C156S/E169T/D204M/S337N | + |
| 633/634 | R12Q/A107C/P131A/D204M/K289A/S337W/P417V/Q451E/S455R | + |
| 635/636 | V9L/A107C/P131A/D204M/T259E/P417V/Q451E | + |
| 637/638 | A107C/D204M | + |
| 639/640 | A107C/L161E/E169T/A199S/D204M/T259E/Q451E | + |

[a]Levels of increased production were determined relative to the reference polypeptide of SEQ ID NO: 520, and defined as follows: "+" = at least 1.15-fold that of the reference but less than 1.25-fold increased production; "++" = at least 1.25-fold but less than 1.36-fold increased production relative to reference polypeptide; and "+++" = at least 1.36-fold increased production.

TABLE 13.2

β1,3GT Saturation Mutagenesis Variants and RebM Levels

| SEQ ID NO: (nt/aa) | Amino Acid Differences (Relative to SEQ ID NO: 520) | Increased RebM[a] |
|---|---|---|
| 641/642 | L257A | ++ |
| 643/644 | K430Q | ++ |
| 645/646 | V413L | ++ |
| 647/648 | K336R | ++ |
| 649/650 | T111C | ++ |
| 651/652 | I410V | ++ |
| 653/654 | T80A | + |
| 655/656 | K53Q | + |
| 657/658 | F221A | + |
| 659/660 | T111S | + |
| 661/662 | L16M | + |
| 663/664 | H95W | + |
| 665/666 | L78V | + |
| 667/668 | A426S | + |
| 669/670 | L391R | + |
| 671/672 | I349V | + |
| 673/674 | T54P | + |
| 675/676 | T111G | + |

[a]Levels of increased production were determined relative to the reference polypeptide of SEQ ID NO: 520, and defined as follows: "+" = at least 1.02-fold that of the reference but less than 1.1-fold increased production; and "++" = at least 1.1-fold increased production.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.005-0.15 g/L SFP in 100 μL total reaction volume of 50 mM potassium phosphate buffer, pH 6, 15 mM stevioside (>95% purity) or rebaudioside D, 0.02 g/L ADP (Amresco, ultra pure grade) co-substrate, 0.03 g/L SUS SFP SEQ ID NO: 2182, and 37.5 mM sucrose (cane sugar). The reactions were incubated in a THERMOTRON® titre-plate shaker with 300 RPM shaking for 4 hours at 60° C. The reactions were solubilized by 20× dilution with water, quenched by 5× dilution with acetonitrile with 0.2% formic acid, cleared by centrifugation, and diluted 15× with water for analysis. Glycosylated products were detected by SPE-QQQ as described in Example 5, Table 5.1. A one-pot reaction was conducted with 0.01-0.3 g/L SFP in 100 μL total reaction volume of 50 mM potassium phosphate buffer, pH 6, 40 g/L RebA60, 0.02 g/L ADP (Amresco, ultra pure grade) co-substrate, 0.03 g/L SUS SFP SEQ ID NO: 2182, 0.12 g/L β1,2 GT SFP SEQ ID NO: 1216, and 60 g/L sucrose (cane sugar). One set of SFP dilutions was pre-incubated at 75° C. for 2 h in 50 mM potassium phosphate buffer, pH 6 with 100 g/L rebaudioside A 60%, while another set was not preincubated. The reactions were incubated in a THERMOTRON® titre-plate shaker with 300 RPM shaking for 16 hours at 60° C. The reactions were solubilized by 40× dilution with water, quenched by 5× dilution with acetonitrile with 0.2% formic acid, cleared by centrifugation, and diluted 20× with water for analysis Similar one-pot reactions were also performed with 10 μL of crude clarified lysate that had been diluted 25× in 50 mM potassium phosphate buffer, pH 6, with 100 g/L rebaudioside A 60% and incubated 24 h at 75.2° C.

TABLE 13.3

β1,3 GT Shake Flask Powder Variants and RebA, RebM from RebD, and RebM from RebA60, and Thermostability Levels

| SEQ ID NO: (nt/aa) | Amino Acid Differences (Relative to SEQ ID NO: 520) | Increased RebA[a] | Increased RebM[a] | Increased RebM (from A60)[a] | Increased RebM (from A60, A60 preincubated)[a] | % Activity Remaining[b] |
|---|---|---|---|---|---|---|
| 625/626 | A107C/A199S/D204M/K289A | +++ | + | ++ | ++ | + |
| 617/618 | R12Q/V14I/A107C/D204M/K289A/S455R | +++ | + | ++ | ++ | + |
| 589/590 | D204M/Q451E/S455R | ++ | + | ++ | +++ | + |
| 591/592 | V9L/R12Q/A199S/D204M/E209Y/S337N/S455R | +++ | + | + | ++ | − |
| 639/640 | A107C/L161E/E169T/A199S/D204M/T259E/Q451E | +++ | + | + | ++ | − |
| 593/594 | V9L/D204M | + | + | + | ++ | − |
| 609/610 | V9L/P131A/C156S/E209Y/K289A/S337N | + | + | + | ++ | + |

[a]Levels of increased production were determined relative to the reference polypeptide of SEQ ID NO: 520, at 0.02 g/L shake flask powder for single substrate and 0.04 g/L for one-pot and defined as follows: "+" = production at least that of the reference but less than 1.1-fold reference polypeptide; "++" = at least 1.1-fold increased production but less than 1.25-fold; and "+++" = at least 1.25-fold increased production relative to reference polypeptide.
[b]The percent of activity remaining for each variant was determined following 24 h pre-incubation at 75.2° C., relative to the production from each variant following 24 h pre-incubation at 65° C. and is defined as follows: "−" = less than 30% of activity remained following 24 h pre-incubation at 65° C.; and "+" = at least 30% activity remained.

In these experiments, all seven variants in Table 13.3 produced more rebaudioside M from rebaudioside A 60 and from rebaudioside D and more rebaudioside A from stevioside than SEQ ID NO: 520. Four variants had similar thermostability to SEQ ID NO: 520. The variant with the most activity on stevioside and RebA60 without pre-incubation, SEQ ID NO: 626, was used as the starting point for further enzyme engineering.

Example 14

Beta-1,3-ADP-Glycosyltransferase Variants of SEQ ID NO: 626

In this Example, experiments for evolution and screening of β1,3-glycosyltransferase (β1,3GT) polypeptides derived from SEQ ID NO: 626 for improved glucosylation of steviol glycosides using in situ synthesized ADP-glucose are described. Directed evolution of the GT encoded by SEQ ID NO: 625 (i.e., SEQ ID NO: 626) was carried out by constructing libraries of variant genes in which mutations associated with improved production identified during the development of the present invention were recombined and in which certain structural features were subjected to saturation mutagenesis. These libraries were then plated, grown, and screened using the high-throughput (HTP) assay described below to provide another round of 43 engineered GT variant polypeptides with glucosyltransferase activity toward ADP-glucose and steviol glycosides.

HTP Assay for Glucose Transfer from Sucrose to ADP and then from ADP-Glucose to Rebaudioside A 60

Assays were performed on 96-well plates of cleared E. coli culture lysates expressing SEQ ID NO: 625 variants (i.e., variants of SEQ ID NO: 626). Pellets were lysed, and lysate was cleared as described in Example 6, and then diluted 100× into 50 mM potassium phosphate buffer, pH 6 with 100 g/L of rebaudioside A 60%. In order to thermally challenge the lysates, they were pre-incubated at 75° C. in a THERMOTRON® titre-plate shaker with 300 RPM shaking for 2 h. Assays were conducted with 10 μL pre-incubated lysate in 100 μL reactions and with 40 g/L rebaudioside A 60% substrate, 0.02 g/L ADP (Amresco, ultra pure grade) co-substrate, 0.06 g/L SUS SFP SEQ ID NO: 2182, 0.09 g/L β-1,2-glycosyltransferase (β12GT) SEQ ID NO: 1488, and 60 g/L sucrose (cane sugar). The following reaction conditions were used: 50 mM potassium phosphate buffer, pH 6, 60° C. in a THERMOTRON® titre-plate shaker with 300 RPM shaking for 16 h. Reactions were solubilized by 40× dilution with water, quenched by 5× dilution with acetonitrile with 0.2% formic acid, and diluted 20× with water for analysis. Samples were analyzed by RapidFire-MS/MS as described in Example 5, Table 5.1. Glycosyltransferase variant polypeptides that produced rebaudioside M from rebaudioside A 60 with in situ synthesized ADP-glucose at greater quantities than SEQ ID NO: 626 were identified. The engineered polypeptides are listed in Table 14.1 and Table 14.2. Shake-flask scale cultures were grown, lysed, cleared, and lyophilized to powder as described in Example 1 for analysis of variants shown in Table 14.3 relative to SEQ ID NO: 626.

TABLE 14.1

β1,3GT Combinatorial Variants and RebM Levels

| SEQ ID NO: (nt/aa) | Amino Acid Differences (Relative to SEQ ID NO: 626) | Increased RebM[a] |
|---|---|---|
| 693/694 | L16M/F221A/I410V | +++ |
| 695/696 | L16M/T80A/F221A/L257A/K336R/I410V | +++ |
| 681/682 | L16M/F221A/L257A | +++ |
| 683/684 | L16M/T111S/F221A | +++ |

TABLE 14.1-continued

β1,3GT Combinatorial Variants and RebM Levels

| SEQ ID NO: (nt/aa) | Amino Acid Differences (Relative to SEQ ID NO: 626) | Increased RebM[a] |
|---|---|---|
| 685/686 | T80A/T111S/F221A/L257A/I410V | ++ |
| 687/688 | F221A | ++ |
| 689/690 | L16M/F221A/L257A/K336R/L391R | ++ |
| 691/692 | L16M/L257A | ++ |
| 693/694 | L16M/F221A | ++ |
| 695/696 | T111S/F221A/L257A/L391R | ++ |
| 697/698 | L16M | + |
| 699/700 | L16M/T80A/T111C | + |
| 701/702 | L16M/T80A/F221A/K336R/I410V | + |
| 703/704 | L16M/T80A | + |
| 705/706 | F221A/L257A | + |
| 707/708 | L16M/L257A/K336R/V413L/E420G | + |
| 709/710 | T111S/F221A/L257A/K336R/L391R | + |
| 711/712 | L16M/T80A/L257A | + |
| 713/714 | L16M/T111C/F221A/L257A/L391R | + |
| 715/716 | L16M/T80A/T111S/L257A | + |
| 717/718 | L16M/H59Q/T80A/V413L | + |

[a]Levels of increased production were determined relative to the reference polypeptide of SEQ ID NO: 626, and defined as follows: "+" = at least 1.15-fold that of the reference but less than 1.22-fold increased production; "++" = at least 1.22-fold but less than 1.28-fold increased production relative to reference polypeptide; and "+++" = at least 1.28-fold increased production.

TABLE 14.2

β1,3GT Saturation Mutagenesis Variants and RebM Levels

| SEQ ID NO: (nt/aa) | Amino Acid Differences (Relative to SEQ ID NO: 626) | Increased RebA[a] | Increased RebM[a] | Increased RebM (from A60)[a] |
|---|---|---|---|---|
| 719/720 | S194P | + | +++ | +++ |
| 721/722 | S5N | + | +++ | +++ |
| 723/724 | S5M | + | +++ | +++ |
| 725/726 | S5L | + | +++ | +++ |
| 727/728 | A118V | + | ++ | ++ |
| 729/730 | V286L | + | ++ | ++ |
| 731/732 | S254T | + | +++ | ++ |
| 733/734 | E418D | + | +++ | ++ |
| 735/736 | K102R | + | ++ | ++ |
| 737/738 | A118S | + | ++ | ++ |
| 739/740 | Q91V | + | + | ++ |
| 741/742 | V14L | + | + | + |
| 743/744 | E99S | + | + | + |
| 745/746 | E99L | + | + | + |
| 747/748 | D416E | + | + | + |
| 749/750 | S254G | + | + | + |
| 751/752 | T7L | + | ++ | + |
| 753/754 | L138I | + | + | + |
| 755/756 | S254V | + | + | + |
| 757/758 | S5Q | + | + | + |
| 759/760 | E420A | + | + | + |
| 761/762 | I65V | + | + | + |

[a]Levels of increased production were determined relative to the reference polypeptide of SEQ ID NO: 626, and defined as follows: "+" = at least 0.95-fold that of the reference but less than 1.15-fold increased production; "++" = at least 1.15-fold that of the reference but less than 1.3-fold increased production; and "+++" = at least 1.3-fold increased production.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.005-0.15 g/L SFP in 100 µL total reaction volume of 50 mM potassium phosphate buffer, pH 6, 15 mM stevioside (>95% purity) or rebaudioside D, 0.02 g/L ADP (Amresco, ultra pure grade) co-substrate, 0.03 g/L SUS SFP SEQ ID NO: 2182, and 37.5 mM sucrose (cane sugar). The reactions were incubated in a THERMOTRON® titre-plate shaker with 300 RPM shaking for 4 hours at 60° C. The reactions were solubilized by 20× dilution with water, quenched by 5× dilution with acetonitrile with 0.2% formic acid, cleared by centrifugation, and diluted 15× with water for analysis. Glycosylated products were detected by SPE-QQQ as described in Example 5, Table 5.1. A one-pot reaction was conducted with 0.01-0.3 g/L SFP in 100 µL total reaction volume of 50 mM potassium phosphate buffer, pH 6, 50 g/L RebA60, 0.025 g/L ADP (Amresco, ultra pure grade) co-substrate, 0.075 g/L SUS SFP SEQ ID NO: 2182, 0.09 g/L β1,2 GT SFP SEQ ID NO: 1488, and 75 g/L sucrose (cane sugar). One set of SFP dilutions was pre-incubated at 75° C. for 2 h in 50 mM potassium phosphate buffer, pH 6 with 100 g/L rebaudioside A 60%, while another set was not preincubated. The reactions were incubated in a THERMOTRON® titre-plate shaker with 300 RPM shaking for 16 hours at 60° C. The reactions were solubilized by 50× dilution with water, quenched by 5× dilution with acetonitrile with 0.2% formic acid, cleared by centrifugation, and diluted 20× with water for analysis. Similar one-pot reactions were also performed with 10 µL of crude clarified lysate that had been diluted 25× in 50 mM potassium phosphate buffer, pH 6, with 100 g/L rebaudioside A 60% and incubated 24 h at 75.2° C.

TABLE 14.3

β1,3GT Shake Flask Powder Variants and RebA, RebM from RebD, and RebM from RebA60, and Thermostability Levels

| SEQ ID NO: (nt/aa) | Amino Acid Differences (Relative to SEQ ID NO: 626) | Increased RebA[a] | Increased RebM[a] | Increased RebM (from A60)[a] | Increased RebM (from A60, A60 preincubated)[a] | % Activity Remaining[b] |
|---|---|---|---|---|---|---|
| 687/688 | F221A | + | − | − | + | + |
| 681/682 | L16M/F221A/L257A | ++ | + | + | + | ++ |
| 691/692 | L16M/L257A | + | − | + | + | + |
| 683/684 | L16M/T111S/F221A | − | − | − | − | + |
| 679/680 | L16M/T80A/F221A/L257A/K336R/I410V | +++ | − | + | + | +++ |
| 685/686 | T80A/T111S/F221A/L257A/I410V | ++ | − | + | + | + |
| 677/678 | L16M/F221A/I410V | ++ | + | + | ++ | ++ |

[a]Levels of increased production were determined relative to the reference polypeptide of SEQ ID NO: 626, at 0.02 g/L shake flask powder for single substrate and 0.04 g/L for one-pot and defined as follows: "−" = production less than 0.9-fold that of the reference polypeptide; "+" = production at least 0.9-fold that of the reference but less than 1.15-fold reference polypeptide; "++" = at least 1.15-fold increased production but less than 1.3-fold; and "+++" = at least 1.3-fold increased production relative to reference polypeptide.
[b]The percent of activity remaining for each variant was determined following 24 h pre-incubation at 75.2° C., relative to the production from each variant following 24 h pre-incubation at 65° C. and is defined as follows: "+" = at least 27% of activity remained following 24 h pre-incubation at 75.2° C. but less than 57%; "+" = at least 57% of activity remained but less than 70%; and "+++" = at least 70% activity remained.

In these experiments, five variants in Table 14.3 produced more rebaudside M from rebaudioside A 60 than SEQ ID NO: 626. Of these, one variant, SEQ ID NO: 678, was also improved for catalyzing the glucosylation of stevioside to rebaudioside A and rebaudioside D to rebaudioside M, as well as more thermostable than SEQ ID NO: 626. This active and thermostable variant, SEQ ID NO: 678, was used as the starting point for further enzyme engineering.

Example 15

Beta-1,3-ADP-Glycosyltransferase Variants of SEQ ID NO: 678

In this Example, experiments for evolution and screening of β1,3-glycosyltransferase (β1,3GT) polypeptides derived from SEQ ID NO: 678 for improved glucosylation of steviol glycosides using in situ synthesized ADP-glucose are described. Directed evolution of the GT encoded by SEQ ID NO: 677 (i.e., SEQ ID NO: 678) was carried out by constructing libraries of variant genes in which mutations associated with improved production identified during the development of the present invention were recombined. These libraries were then plated, grown, and screened using the high-throughput (HTP) assay described below to provide another round of 47 engineered GT variant polypeptides with glucosyltransferase activity toward ADP-glucose and steviol glycosides.

HTP Assay for Glucose Transfer from Sucrose to ADP and then from ADP-Glucose to Rebaudioside A 60

Assays were performed on 96-well plates of cleared E. coli culture lysates expressing SEQ ID NO: 677 variants (i.e., variants of SEQ ID NO: 678). Pellets were lysed, and lysate was cleared as described in Example 6, and then diluted 70× into 50 mM potassium phosphate buffer, pH 6 with 100 g/L of rebaudioside A 60%. In order to thermally challenge the lysates, they were pre-incubated at 75° C. in a THERMOTRON® titre-plate shaker with 300 RPM shaking for 2 h. Assays were conducted with 10 μL pre-incubated lysate in 100 μL reactions and with 50 g/L rebaudioside A 60% substrate, 0.025 g/L ADP (Amresco, ultra pure grade) co-substrate, 0.075 g/L SUS SFP SEQ ID NO: 2322, 0.09 g/L β-1,2-glycosyltransferase (β12GT) SEQ ID NO: 1488, and 75 g/L sucrose (cane sugar). The following reaction conditions were used: 50 mM potassium phosphate buffer, pH 6, 60° C. in a THERMOTRON® titre-plate shaker with 300 RPM shaking for 16 h. Reactions were solubilized by 50× dilution with water, quenched by 5× dilution with acetonitrile with 0.2% formic acid, and diluted 20× with water for analysis. Samples were analyzed by RapidFire-MS/MS as described in Example 5, Table 5.1. Glycosyltransferase variant polypeptides that produced rebaudioside M from rebaudioside A 60 with in situ synthesized ADP-glucose at greater quantities than SEQ ID NO: 678 were identified. The engineered polypeptides are listed in Table 15.1. Shake-flask scale cultures were grown, lysed, cleared, and lyophilized to powder as described in Example 1 for analysis of variants shown in Table 15.2 relative to SEQ ID NO: 678.

TABLE 15.1

β1,3 GT Combinatorial Variants and RebM Levels

| SEQ ID NO: (nt/aa) | Amino Acid Differences (Relative to SEQ ID NO: 678) | Increased RebM[a] |
|---|---|---|
| 763/764 | S5N/Q91V/S194P/E418D | +++ |
| 765/766 | S5N/Q91V/A118S/V286L | +++ |
| 767/768 | S5N/Q91V/S106I/S254T/V286L | +++ |
| 769/770 | S5N/A118S/S194P/V286L/E418D | +++ |
| 771/772 | S5N/S194P | +++ |
| 773/774 | Q91V/A118V/S194P | +++ |
| 775/776 | S5N/Q91V | +++ |
| 777/778 | S5N/Q91V/S254T/V286L | +++ |
| 779/780 | V14L/E99L | +++ |
| 781/782 | S5N/Q91V/A118V/S194P/S254T/V286L | ++ |
| 783/784 | S5N/A118V/S254T | ++ |
| 785/786 | T7L/V14L/I65V/E99L | ++ |
| 787/788 | Q91V/A118V/S194P/V286L | ++ |

TABLE 15.1-continued

β1,3 GT Combinatorial Variants and RebM Levels

| SEQ ID NO: (nt/aa) | Amino Acid Differences (Relative to SEQ ID NO: 678) | Increased RebM[a] |
|---|---|---|
| 789/790 | V14L/E99L/S254G | ++ |
| 791/792 | S5N/Q91V/S194P/S254T | ++ |
| 793/794 | A118V/V286L/E418D | ++ |
| 795/796 | S5N/K102R/E418D | ++ |
| 797/798 | V14L/S455R | ++ |
| 799/800 | V14L/E99S/D416E | ++ |
| 801/802 | S5N/A118S/V286L | ++ |
| 803/804 | V14L/D167E | ++ |
| 805/806 | S5L/V14L/E99L | ++ |
| 807/808 | V14L/E99L/S254G/D416E/S455R | ++ |
| 809/810 | Q91V/A118V/V286L | + |
| 811/812 | S5N/Q91V/A118V/S194P/E418D | + |
| 813/814 | S5N/Q91V/K102R/S254T/E418D | + |
| 815/816 | V14L/E99L/D416E | + |
| 817/818 | V14L/S254G | + |
| 819/820 | V14L | + |
| 821/822 | V14L/I65V/E99L/D416E | + |
| 823/824 | S5N/Q91V/A118S/S254T/V286L/E418D | + |
| 825/826 | T7L/V14L/E99S/D416E | + |
| 827/828 | S5N/Q91V/A118S/S194P/S254T/E418D | + |
| 829/830 | S5N/Q91V/K102R/A118V | + |
| 831/832 | Q91V/A118V | + |
| 833/834 | Q91V/K102R/S194P | + |
| 835/836 | V14L/E99L/S254G/D416E | + |
| 837/839 | Q91V | + |
| 841/840 | S5N | + |
| 841/842 | T7L/V14L | + |
| 843/844 | Q91V/S194P/S254T/V286L | + |
| 845/846 | S5N/Q91V/S254T | + |
| 847/848 | S5N/E418D | + |
| 849/850 | Q91V/A118V/S194P/E418D | + |
| 851/852 | S5L/V14L/D416E | + |
| 853/854 | Q91V/V286L | + |
| 855/856 | S5N/S254T/V286L | + |

[a]Levels of increased production were determined relative to the reference polypeptide of SEQ ID NO: 678, and defined as follows: "+" = at least 1.32-fold that of the reference but less than 1.46-fold increased production; "++" = at least 1.46-fold but less than 1.62-fold increased production relative to reference polypeptide; and "+++" = at least 1.62-fold increased production.

SFP Characterization Assay and Analysis for Glucosyl Transfer from Sucrose to ADP and then from ADP-Glucose to Stevioside and Rebaudioside D Shake flask powders (SFP) were reconstituted to a concentration of 20 g/L and diluted to 0.0125-0.2 g/L SFP in 100 μL total reaction volume of 50 mM potassium phosphate buffer, pH 6, 15 mM stevioside (>95% purity) or rebaudioside D or rebaudioside E (prepared in house from stevioside treated with β1,2GT), 0.02 g/L ADP (Amresco, ultra pure grade) co-substrate, 0.025 g/L SUS SFP SEQ ID NO: 2322, and 37.5 mM sucrose (cane sugar). The reactions were incubated in a THERMOTRON® titre-plate shaker with 300 RPM shaking for 4 hours at 60° C. The reactions were solubilized by 20× dilution with water, quenched by 5× dilution with acetonitrile with 0.2% formic acid, cleared by centrifugation, and diluted 15× with water for analysis. Glycosylated products were detected by SPE-QQQ as described in Example 5, Table 5.1. A one-pot reaction was conducted with 0.0125-0.2 g/L SFP in 100 μL total reaction volume of 50 mM potassium phosphate buffer, pH 6, 100 g/L RebA60, 0.05 g/L ADP (Amresco, ultra pure grade) co-substrate, 0.2 g/L SUS SFP SEQ ID NO: 2322, 0.2 g/L β1,2GT SFP SEQ ID NO: 1516, and 150 g/L sucrose (cane sugar). One set of SFP dilutions was pre-incubated at 75° C. for 2 h in 50 mM potassium phosphate buffer, pH 6 with 100 g/L rebaudioside A 60%, while another set was not preincubated. The reactions were incubated in a THERMOTRON® titre-plate shaker with 300 RPM shaking for 16 hours at 60° C. The reactions were solubilized by 100× dilution with water, quenched by 5× dilution with acetonitrile with 0.2% formic acid, cleared by centrifugation, and diluted 20× with water for analysis Similar one-pot reactions were also performed with 10 μL of crude clarified lysate that had been diluted 25× in 50 mM potassium phosphate buffer, pH 6, with 100 g/L rebaudioside A 60% and incubated 24 h at 75.2° C.

TABLE 15.2

β1,3 GT Shake Flask Powder Variants and RebA; RebM from RebD, RebE, and RebA60; and Thermostability Levels

| SEQ ID NO: (nt/aa) | Amino Acid Differences (Relative to SEQ ID NO: 678) | Increased RebA[a] | Increased RebM (from RebE)[a] | Increased RebM (from RebD)[a] | Increased RebM (from A60)[a] | Increased RebM (from A60, A60 pre-incubated)[a] | % Activity Remaining[b] |
|---|---|---|---|---|---|---|---|
| 767/768 | S5N/Q91V/S106I/S254T/V286L | + | +++ | + | ++ | +++ | ++ |
| 765/766 | S5N/Q91V/A118S/V286L | − | +++ | + | ++ | +++ | − |
| 777/778 | S5N/Q91V/S254T/V286L | − | ++ | + | + | ++ | |
| 819/820 | V14L | + | − | + | − | + | − |
| 779/780 | V14L/E99L | + | + | + | + | + | + |
| 821/822 | V14L/I65V/E99L/D416E | + | − | − | − | + | + |
| 789/790 | V14L/E99L/S254G | + | + | + | + | + | + |

[a]Levels of increased production were determined relative to the reference polypeptide of SEQ ID NO: 678, at 0.025 g/L shake flask powder and defined as follows: "−" = production less than 0.9-fold that of the reference polypeptide; "+" = production at least 0.9-fold of the reference but less than 1.1-fold reference polypeptide; "++" = at least 1.1-fold increased production but less than 1.3-fold; and "+++" = at least 1.3-fold increased production relative to reference polypeptide.
[b]The percent of activity remaining for each variant was determined following 24 h pre-incubation at 75.2° C., relative to the production from each variant following 24 h pre-incubation at 65° C. and is defined as follows: "−" = less than 30% of activity remained following 24 h pre-incubation at 75.2° C.; "+" = at least 30% activity remained, but there was less than 39% activity remaining; and "++" = at least 39% activity remained.

In these experiments, three variants in Table 15.2 produced more rebaudioside M from rebaudioside A 60 than SEQ ID NO: 678. Of these, one variant, SEQ ID NO: 768, was also at least as thermostable as SEQ ID NO: 678. Therefore, SEQ ID NO: 768 was selected as the best enzyme for the catalysis of glycosyltransfer from ADP-glucose to stevioside and rebaudioside D for the formation of rebaudioside A and rebaudioside M, respectively.

Example 16

Beta-1,2-ADP-Glycosyltransferase Variants of SEQ ID NO: 24

In this Example, experiments for evolution and screening of GT polypeptides derived from SEQ ID NO: 24, for improved glucosylation of steviol glycosides using ADP-glucose are described. Directed evolution of the GT encoded by SEQ ID NO: 23 was carried out by constructing libraries of variant genes. Libraries recombined mutations associated with improved production identified during the development of the present invention and subjected certain structural features of the enzyme with saturation mutagenesis. These libraries were then plated, grown, and screened using the HTP assay described below to provide another round of engineered GT variant polypeptides with glucosyltransferase activity toward ADP-glucose and steviol glycosides. Sixteen engineered variants were identified from the combinatorial libraries (Table 16.1), and fifty-one were identified from the saturation mutagenesis libraries (Table 16.2).

HTP Coupled Assay for Glucose Transfer from Sucrose to ADP to Rebaudioside A 60

Assays were performed on 96-well plates of cleared *E. coli* culture lysates expressing SEQ ID NO: 23 variants (i.e., variants of SEQ ID NO: 24). Lysis buffer volume was 400 μL, and the lysate was diluted 150-fold into 50 mM potassium phosphate, pH 6.0, and pre-incubated for 1 h at 75° C. Assays were then conducted with 10 μL diluted lysate, 0.03 g/L SUS SFP SEQ ID NO: 22, and 0.1 g/L β-1,3-glycosyltransferase (β1,3GT) SFP SEQ ID NO: 20, in 100 μL reaction volume with 20 g/L rebaudioside A 60% (RebA60) substrate, 0.02 g/L ADP (Amresco, ultra pure grade) co-substrate, and 30 g/L sucrose. The following reaction conditions were used: 50 mM potassium phosphate buffer, pH 6, 60° C. in a THERMOTRON® titre-plate shaker with 300 RPM shaking for 16-18 h. The reactions were solubilized by 20× dilution into water, quenched by 5× dilution into acetonitrile with 0.2% formic acid, precipitated by centrifugation, and diluted 20× into water for analysis as described above. The resulting engineered variants with glucosyltransferase activity on RebA60 are listed in Table 16.1 and 16.2. Shake-flask scale cultures were grown, lysed, and lyophilized to powder for variants listed in Table 16.3.

TABLE 16.1

β1,2 GT Combinatorial Variants and RebM Levels

| SEQ ID NO: (nt/aa) | Amino Acid Differences (Relative to SEQ ID NO: 24) | Increased RebM[a] |
|---|---|---|
| 857/858 | L16T/Q127V/P169E | +++ |
| 859/860 | L16T/R423L/R427S | +++ |
| 861/862 | L16T/P169E | +++ |
| 863/864 | L16T/P169E/A398M/Q399K | ++ |
| 865/866 | R423L/R427S | ++ |
| 867/868 | L16T | ++ |
| 869/870 | L16T/P169E/R423L | ++ |
| 871/872 | L16T/R423L | ++ |
| 873/874 | A134S | + |
| 875/876 | Q399K/R423L | + |
| 877/878 | L16T/A398M/R427S | + |
| 879/880 | P143G | + |
| 881/882 | L16T/P143G/R423L | + |
| 883/884 | L16T/A134S | + |
| 885/886 | L16T/A398M | + |
| 887/888 | L16T/A398M/Q399K | + |

[a]Levels of increased production were determined relative to the reference polypeptide of SEQ ID NO: 24, and defined as follows: "+" = production at least 1.15-fold that of the reference but less than 1.18-fold reference polypeptide; "++" = at least 1.18-fold increased production but less than 1.21-fold; and "+++" = at least 1.21-old increased production.

TABLE 16.2

β1,2GT Saturation Mutagenesis Variants and RebM Levels

| SEQ ID NO: (nt/aa) | Amino Acid Differences (Relative to SEQ ID NO: 24) | Increased RebM[a] |
|---|---|---|
| 889/890 | Y44E | +++ |
| 891/892 | C443G | +++ |
| 893/894 | H164A | +++ |
| 895/896 | P233S | +++ |
| 897/898 | E221D | +++ |
| 899/900 | H164E | +++ |
| 901/902 | I248M | +++ |
| 903/904 | R446L | +++ |
| 905/906 | Q137T | +++ |
| 907/908 | S421G | +++ |
| 909/910 | H3I | ++ |
| 911/912 | P60T | ++ |
| 913/914 | K56A | ++ |
| 915/916 | I392V | ++ |
| 917/918 | I440M | ++ |
| 919/920 | L322R | ++ |
| 921/922 | G281S | ++ |
| 923/924 | V400C | ++ |
| 925/926 | N433G | ++ |
| 927/928 | A426S | ++ |
| 929/930 | H164Q | ++ |
| 931/932 | R427W | ++ |
| 933/934 | H3V | ++ |
| 935/936 | F158V | ++ |
| 937/938 | F41M | ++ |
| 939/940 | F158H | + |
| 941/942 | I139T | + |
| 943/944 | L122C | + |
| 945/946 | R427A | + |
| 947/948 | V8R | + |
| 949/950 | S285A | + |
| 951/952 | L135V | + |
| 953/954 | Q301G | + |
| 955/956 | P232A | + |
| 957/958 | P233T | + |
| 959/960 | H164S | + |
| 961/962 | C443H | + |
| 963/964 | Q235M | + |
| 965/966 | Q11L | + |
| 967/968 | G138K | + |
| 969/970 | L284V | + |
| 971/972 | D249R | + |
| 973/974 | N433T | + |
| 975/976 | A372S | + |
| 977/978 | H164N | + |
| 979/980 | G138R | + |

TABLE 16.2-continued

β1,2GT Saturation Mutagenesis Variants and RebM Levels

| SEQ ID NO: (nt/aa) | Amino Acid Differences (Relative to SEQ ID NO: 24) | Increased RebM[a] |
|---|---|---|
| 981/982 | I440L | + |
| 983/984 | R176S | + |
| 985/986 | S421A | + |
| 987/988 | Q235L | + |
| 989/990 | Q11P | + |

[a]Levels of increased production were determined relative to the reference polypeptide of SEQ ID NO: 24, and defined as follows: "+" = production at least that of the reference but less than 1.06-fold reference polypeptide; "++" = at least 1.06-fold increased production but less than 1.18-fold; and "+++" = at least 1.18-fold increased production.

Shake Flask Powder Characterization Assay and Analysis for Glucosyl Transfer from Sucrose to ADP to Rebaudioside A 60

Shake flask powders (SFP) were reconstituted to a concentration of 4 g/L and diluted to 0.0013-0.04 g/L in 100 μL total reaction volume containing 50 mM potassium phosphate buffer, pH 6, 20 g/L RebA97 (single substrate) or RebA60 (one-pot), 0.02 g/L ADP, 20 (single substrate) or 30 g/L (one-pot) sucrose, 0.04 g/L SUS SFP SEQ ID NO: 22, and, for the one-pot reaction only, 0.15 g/L β-1,3-glycosyltransferase (β1,3GT) SFP SEQ ID NO: 36. The reactions were performed at 60° C. in a THERMOTRON® titre-plate shaker at 300 RPM for 4 h (single substrate) or 16-18 h (one-pot). One set of SFP dilutions was pre-incubated for 1 h at 75° C. in 50 mM potassium phosphate buffer, pH 6, while another set was not pre-incubated. The reactions were solubilized by 20× dilution with water, quenched by 5× dilution with acetonitrile with 0.2% formic acid, cleared by centrifugation, and diluted 20× with water for analysis. Glycosylated products were detected by SPE-QQQ as described in Example 5, Table 5.1. To assess thermostability, similar single substrate rebaudioside A reactions were also performed with 10 μL of crude clarified lysate that had been diluted 200× in 50 mM potassium phosphate buffer, pH 6, and incubated 24 h at 66.2° C. The thermostability results and production levels of rebaudioside D in the single substrate and rebaudioside M in the one-pot reactions by these variants at 0.01 g/L SFP loading are shown in Table 16.3.

TABLE 16.3

β1,2GT Shake Flask Variants and RebD and RebM Levels

| SEQ ID NO: (nt/aa) | Amino Acid Differences (Relative to SEQ ID NO: 24) | Increased RebD[a] | Increased RebM[a] | Increased RebM (pre-incubated)[a] | % Activity Remaining[b] |
|---|---|---|---|---|---|
| 867/868 | L16T | ++ | ++ | + | ++ |
| 857/858 | L16T/Q127V/P169E | ++ | ++ | ++ | ++ |
| 861/862 | L16T/P169E | + | + | + | + |

[a]Levels of increased production were determined relative to the reference polypeptide of SEQ ID NO: 24, and defined as follows: "+" = production at least that of the reference but less than 1.1-fold reference polypeptide; and "++" = at least 1.1-fold increased production.
[b]The percent of activity remaining for each variant was determined following 23 h pre-incubation at 66.2° C., relative to the production from each variant following 24 h pre-incubation at 60° C. and is defined as follows: "+" = at least 50% but less than 60% of activity remained following 23 h pre-incubation at 66.2° C. and "++" = at least 60% activity remained.

In these experiments, the three variants in Table 16.3 were improved relative to SEQ ID NO: 24, for catalyzing the glucosylation of rebaudioside A to rebaudioside D and for catalyzing the β1,2-glucosylations involved in converting rebaudioside A 60% to rebaudioside M. Two of these variants were also more thermostable than SEQ ID NO: 24. Of these, the variant that was most improved with pre-incubation, SEQ ID NO: 858, was selected as the starting point for further enzyme engineering.

Example 17

Beta-1,2-ADP-Glycosyltransferase Variants of SEQ ID NO: 858

In this Example, experiments for evolution and screening of GT polypeptides derived from SEQ ID NO: 858, for improved glucosylation of steviol glycosides using ADP-glucose are described. Directed evolution of the GT encoded by SEQ ID NO: 857 was carried out by constructing libraries of variant genes. Libraries recombined mutations associated with improved production identified during the development of the present invention. These libraries were then plated, grown, and screened using the HTP assay described below to provide another round of engineered GT variant polypeptides with glucosyltransferase activity toward ADP-glucose and steviol glycosides. Forty-four engineered variants were identified from the combinatorial libraries (Table 17.1).

HTP Coupled Assay for Glucose Transfer from Sucrose to ADP to Rebaudioside A 60

Assays were performed on 96-well plates of cleared E. coli culture lysates expressing SEQ ID NO: 857 variants (i.e., variants of SEQ ID NO: 858). Lysis buffer volume was 400 μL, and the lysate was diluted 200-fold into 50 mM potassium phosphate, pH 6.0, and pre-incubated for 2 h at 75° C. Assays were then conducted with 10 μL diluted lysate, 0.03 g/L SUS SFP SEQ ID NO: 1652, and 0.1 g/L β-1,3-glycosyltransferase (β1,3GT) SFP SEQ ID NO: 174, in 100 μL reaction volume with 20 g/L rebaudioside A 60% (RebA60) substrate, 0.02 g/L ADP (Amresco, ultra pure grade) co-substrate, and 30 g/L sucrose. The following reaction conditions were used: 50 mM potassium phosphate buffer, pH 6, 60° C. in a THERMOTRON® titre-plate shaker with 300 RPM shaking for 16-18 h. The reactions were solubilized by 20× dilution into water, quenched by 5× dilution into acetonitrile with 0.2% formic acid, precipitated by centrifugation, and diluted 20× into water for analysis as described above. The resulting engineered variants with glucosyltransferase activity on RebA60 are listed in Table 17.1. Shake-flask scale cultures were grown, lysed, and lyophilized to powder for variants listed in Table 17.2.

TABLE 17.1

β1,2GT Combinatorial Variants and RebM Levels

| SEQ ID NO: (nt/aa) | Amino Acid Differences (Relative to SEQ ID NO: 858) | Increased RebM[a] |
|---|---|---|
| 991/992 | H3I/A22G/G198Q/S421G | +++ |
| 993/994 | A22G/G198Q/I202Y/I248M/I392V | +++ |
| 995/996 | A22G/K56A/S421G/R423L | +++ |
| 997/998 | H164E/P233S/I331V/I440M | +++ |
| 999/1000 | F125L/P233S/C443G/R446L | +++ |
| 1001/1002 | A22G/K56A | +++ |
| 1003/1004 | P233S | +++ |
| 1005/1006 | A22G/S421G/R423L | +++ |
| 1007/1008 | A22G/I392V | +++ |
| 1009/1010 | A22G/K56A/Q137T/G198Q/G201A/I248M/L322R/I392V | ++ |
| 1011/1012 | L13Q/P233S/I331V/I440M | ++ |
| 1013/1014 | H3I/A22G/S421G | ++ |
| 1015/1016 | A22G/R423L | ++ |
| 1017/1018 | H164A/I331V | ++ |
| 1019/1020 | A22G/K56A/G198Q/I248M/S421G/R423L | ++ |
| 1021/1022 | H164E/E221D/P233S/I331V/I440M/R446L | ++ |
| 1023/1024 | A22G/K56A/G198Q/I248M/L322R/I392V/S421G | ++ |
| 1025/1026 | H164A/P233S/R446L | ++ |
| 1027/1028 | A22G/Q137T | ++ |
| 1029/1030 | A22G/K56A/G198Q/I202Y/I248M | ++ |
| 1031/1032 | C443G/R446L | ++ |
| 1033/1034 | A22G/I248M/I392V | ++ |
| 1035/1036 | G198Q/I202Y/I392V | + |
| 1037/1038 | A329L | + |
| 1039/1040 | A22G/K56A/Q137T/G198Q/I248M/I392V/S421G | + |
| 1041/1042 | H3I/G201A/I248M/L322R/I392V | + |
| 1043/1044 | H3I/G201A/I248M/L322R | + |
| 1045/1046 | A22G/S421G | + |
| 1047/1048 | P233S/R446L | + |
| 1049/1050 | Y44E/H164E/P233S | + |
| 1051/1052 | H164A/I440M | + |
| 1053/1054 | A22G/K56A/Q137T/L322R | + |
| 1055/1056 | H164A/C443G | + |
| 1057/1058 | F125L | + |
| 1059/1060 | Y44E/H164A/P233S | + |
| 1061/1062 | S421G/R423L | + |
| 1063/1064 | A22G/K56A/Q137T/L322R/I392V/R423L | + |
| 1065/1066 | A22G/Q137T/G198Q/I202Y/I248M | + |
| 1067/1068 | A22G/I32L/K56A/P60T/G198Q/I248M/L322R/I392V/S421G | + |
| 1069/1070 | E221D/A329L/I331V | + |
| 1071/1072 | L13Q/I440M/C443G | + |
| 1073/1074 | A22G/P60T/I392V/S421G | + |
| 1075/1076 | Y44E/I331V | + |
| 1077/1078 | Y44E/H164E/P233S/A329L/I331V | + |

[a] Levels of increased production were determined relative to the reference polypeptide of SEQ ID NO: 858, and defined as follows: "+" = production at least 1.22-fold that of the reference but less than 1.27-fold reference polypeptide; "++" = at least 1.27-fold increased production but less than 1.38-fold; and "+++" = at least 1.38-old increased production.

Shake Flask Powder Characterization Assay and Analysis for Glucosyl Transfer from Sucrose to ADP to Rebaudioside A 60

Shake flask powders (SFP) were reconstituted to a concentration of 4 g/L and diluted to 0.0013-0.04 g/L in 100 μL total reaction volume containing 50 mM potassium phosphate buffer, pH 6, 20 g/L RebA97 (single substrate) or RebA60 (one-pot), 0.02 g/L ADP, 20 (single substrate) or 30 g/L (one-pot) sucrose, 0.03 g/L SUS SFP SEQ ID NO: 1652, and, for the one-pot reaction only, 0.1 g/L β-1,3-glycosyltransferase (β1,3GT) SFP SEQ ID NO: 174. The reactions were performed at 60° C. in a THERMOTRON® titre-plate shaker at 300 RPM for 4 h (single substrate) or 16-18 h (one-pot). One set of SFP dilutions was pre-incubated for 2 h at 75° C. in 50 mM potassium phosphate buffer, pH 6, while another set was not pre-incubated. The reactions were solubilized by 20× dilution with water, quenched by 5× dilution with acetonitrile with 0.2% formic acid, cleared by centrifugation, and diluted 20× with water for analysis. Glycosylated products were detected by SPE-QQQ as described in Example 5, Table 5.1. To assess thermostability, similar single substrate rebaudioside A reactions were also performed with 10 μL of crude clarified lysate that had been diluted 70× in 50 mM potassium phosphate buffer, pH 6, and incubated 24 h at 71.8° C. The thermostability results and production levels of rebaudioside D in the single substrate and rebaudioside M in the one-pot reactions by these variants at 0.005 g/L SFP loading are shown in Table 17.2.

TABLE 17.2

β1,2GT Shake Flask Variants and RebD and RebM Levels

| SEQ ID NO: (nt/aa) | Amino Acid Differences (Relative to SEQ ID NO: 858) | Increased RebD[a] | Increased RebM[a] | Increased RebM (pre-incubated)[a] | % Activity Remaining[b] |
|---|---|---|---|---|---|
| 997/998 | H164E/P233S/I331V/I440M | + | ++ | + | ++ |
| 1071/1072 | L13Q/I440M/C443G | ++ | ++ | + | ++ |
| 1021/1022 | H164E/E221D/P233S/I331V/I440M/R446L | ++ | ++ | + | + |
| 1047/1048 | P233S/R446L | + | + | + | + |
| 1027/1028 | A22G/Q137T | ++ | ++ | + | − |
| 993/994 | A22G/G198Q/I202Y/I248M/I392V | +++ | +++ | + | + |
| 1029/1030 | A22G/K56A/G198Q/I202Y/I248M | +++ | +++ | + | + |
| 991/992 | H3I/A22G/G198Q/S421G | +++ | ++ | ++ | +++ |

[a]Levels of increased production were determined relative to the reference polypeptide of SEQ ID NO: 858, and defined as follows: "+" = production at least that of the reference but less than 1.3-fold reference polypeptide; "++" = at least 1.3-fold but less than 1.6-fold increased production; and "+++" = at least 1.6-fold increased production.
[b]The percent of activity remaining for each variant was determined following 23 h pre-incubation at 71.8° C., relative to the production from each variant following 24 h pre-incubation at 65° C. and is defined as follows: "−" = less than 27% of activity remained following 23 h pre-incubation at 71.8° C.; "+" = at least 27% but less than 37% activity remained; "++" = at least 37% but less than 42% activity remained; and "+++" = at least 42% activity remained.

In these experiments, all eight variants in Table 17.2 were improved relative to SEQ ID NO: 858, for catalyzing the glucosylation of rebaudioside A to rebaudioside D and for catalyzing the β1,2-glucosylations involved in converting rebaudioside A 60% to rebaudioside M. The most active variant on both substrates, SEQ ID NO: 994, was selected as the starting point for further enzyme engineering.

Example 18

Beta-1,2-ADP-Glycosyltransferase Variants of SEQ ID NO: 994

In this Example, experiments for evolution and screening of GT polypeptides derived from SEQ ID NO: 994 for improved glucosylation of steviol glycosides using ADP-glucose are described. Directed evolution of the GT encoded by SEQ ID NO: 994 was carried out by constructing libraries of variant genes. Libraries recombined mutations associated with improved production identified during the development of the present invention and subjected certain structural features of the enzyme with saturation mutagenesis. These libraries were then plated, grown, and screened using the HTP assay described below to provide another round of engineered GT variant polypeptides with glucosyltransferase activity toward ADP-glucose and steviol glycosides. Nineteen engineered variants were identified from the combinatorial libraries (Table 18.1), and twenty-five were identified from the saturation mutagenesis libraries (Table 18.2).

HTP Coupled Assay for Glucose Transfer from Sucrose to ADP to Rebaudioside A 60

Assays were performed on 96-well plates of cleared *E. coli* culture lysates expressing SEQ ID NO: 994 variants (i.e., variants of SEQ ID NO: 994). Lysis buffer volume was 400 μL, and the lysate was diluted 100-fold into 50 mM potassium phosphate, pH 6.0 with and without 20 g/L (combinatorial libraries) or 30 g/L (saturation mutagenesis libraries) rebaudioside A 60%, and pre-incubated for 2 h at 75° C. Assays were then conducted with 10 μL diluted lysate, 0.03 g/L SUS SFP SEQ ID NO: 1822, and 0.1 g/L β-1,3-glycosyltransferase (β1,3GT) SFP SEQ ID NO: 350, in 100 μL reaction volume with 20 g/L rebaudioside A 60% (RebA60) substrate, 0.02 g/L ADP (Amresco, ultra pure grade) co-substrate, and 30 g/L sucrose. The following reaction conditions were used: 50 mM potassium phosphate buffer, pH 6, 60° C. in a THERMOTRON® titre-plate shaker with 300 RPM shaking for 16-18 h. The reactions were solubilized by 20× dilution into water, quenched by 5× dilution into acetonitrile with 0.2% formic acid, precipitated by centrifugation, and diluted 20× into water for analysis as described above. The resulting engineered variants with glucosyltransferase activity on RebA60 are listed in Table 18.1 and 90.2. Shake-flask scale cultures were grown, lysed, and lyophilized to powder for variants listed in Table 18.3.

TABLE 18.1

β1,2GT Combinatorial Variants and RebM Levels

| SEQ ID NO: (nt/aa) | Amino Acid Differences (Relative to SEQ ID NO: 994) | Increased RebM[a] | Increased RebM (A60 preincubated)[a] |
|---|---|---|---|
| 1079/1080 | H164E/Y202I | ++ | ++ |
| 1081/1082 | H83Y/Y202I/P233S | ++ | + |
| 1083/1084 | Y202I/P233S/M248I | ++ | + |
| 1085/1086 | R423L | ++ | + |
| 1087/1088 | Y202I/P233S/M248I/R423L | + | + |
| 1089/1090 | P233S | + | − |
| 1091/1092 | H164E/Y202I/P233S/I331V | + | + |
| 1093/1094 | M248I | + | + |
| 1095/1096 | H164E/R423L | + | + |
| 1097/1098 | Y202I/I331V | + | + |
| 1099/1100 | Y202I/P233S | + | +++ |
| 1101/1102 | H164E | + | + |
| 1103/1104 | Y202I/S421G/R423L | + | +++ |
| 1105/1106 | Y202I/M248I | + | +++ |
| 1107/1108 | H164E/Y202I/I331V/R423L | + | +++ |
| 1109/1110 | Y202I/R423L | + | +++ |
| 1111/1112 | H164E/Y202I/I331V | + | +++ |

TABLE 18.1-continued

β1,2GT Combinatorial Variants and RebM Levels

| SEQ ID NO: (nt/aa) | Amino Acid Differences (Relative to SEQ ID NO: 994) | Increased RebM[a] | Increased RebM (A60 preincubated)[a] |
|---|---|---|---|
| 1113/1114 | Y202I/R446L | + | ++ |
| 1115/1116 | H164E/Y202I/M248I/R272C | + | ++ |

[a]Levels of increased production were determined relative to the reference polypeptide of SEQ ID NO: 994, and defined as follows: "−" = production less than 0.9-fold that of the reference polypeptide; "+" = production at least 0.9-fold that of the reference but less than 1.5-fold reference polypeptide; "++" = at least 1.5-fold increased production but less than 3-fold; and "+++" = at least 3-fold increased production.

TABLE 18.2

β1,2GT Saturation Mutagenesis Variants and RebM Levels

| SEQ ID NO: (nt/aa) | Amino Acid Differences (Relative to SEQ ID NO: 994) | Increased RebM[a] | Increased RebM (A60 preincubated)[a] |
|---|---|---|---|
| 1117/1118 | K422T | ++ | ++ |
| 1119/1120 | S54L | ++ | ++ |
| 1121/1122 | K422A | ++ | +++ |
| 1123/1124 | K422V | ++ | + |
| 1125/1126 | L116I | ++ | ++ |
| 1127/1128 | K132R | ++ | + |
| 1129/1130 | G7T | ++ | + |
| 1131/1132 | Y84L | ++ | ++ |
| 1133/1134 | S9L | ++ | + |
| 1135/1136 | S54M | + | + |
| 1137/1138 | D10P | + | + |
| 1139/1140 | K309E | + | + |
| 1141/1142 | A106S | + | + |
| 1143/1144 | E165P | + | ++ |
| 1145/1146 | S406Q | + | + |
| 1147/1148 | A73S | + | + |
| 1149/1150 | D389E | + | ++ |
| 1151/1152 | N286G | + | +++ |
| 1153/1154 | N115A | + | + |
| 1155/1156 | S406H | + | ++ |
| 1157/1158 | E438A | + | +++ |
| 1159/1160 | A73R | + | + |
| 1161/1162 | E438T | + | +++ |
| 1163/1164 | None—N-terminal DNA expression variant | + | ++ |
| 1165/1166 | S406M | + | + |

[a]Levels of increased production were determined relative to the reference polypeptide of SEQ ID NO: 994, and defined as follows: "+" = production at least 1.1-fold that of the reference but less than 1.18-fold reference polypeptide; "++" = at least 1.18-fold increased production but less than 1.27-fold; and "+++" = at least 1.27-fold increased production.

Shake Flask Powder Characterization Assay and Analysis for Glucosyl Transfer from Sucrose to ADP to Rebaudioside A 60

Shake flask powders (SFP) were reconstituted to a concentration of 4 g/L and diluted to 0.0013-0.04 g/L in 100 μL total reaction volume containing 50 mM potassium phosphate buffer, pH 6, 20 g/L RebA97 (single substrate) or RebA60 (one-pot), 0.02 g/L ADP, 20 (single substrate) or 30 g/L (one-pot) sucrose, 0.03 g/L SUS SFP SEQ ID NO: 1822, and, for the one-pot reaction only, 0.1 g/L β-1,3-glycosyltransferase (β1,3GT) SFP SEQ ID NO: 350. The reactions were performed at 60° C. in a THERMOTRON® titre-plate shaker at 300 RPM for 4 h (single substrate) or 16-18 h (one-pot). One set of SFP dilutions was pre-incubated for 2 h at 75° C. in 50 mM potassium phosphate buffer, pH 6 with 10 g/L rebaudioside A 60%, while another set was not pre-incubated. The reactions were solubilized by 20× dilution with water, quenched by 5× dilution with acetonitrile with 0.2% formic acid, cleared by centrifugation, and diluted 20× with water for analysis. Glycosylated products were detected by SPE-QQQ as described in Example 5, Table 5.1. To assess thermostability, similar one-pot RebA60 reactions were also performed with 10 μL of crude clarified lysate that had been diluted 70× in 50 mM potassium phosphate buffer, pH 6 with 10 g/L RebA60, and incubated 24 h at 71.8° C. The thermostability results and production levels of rebaudioside D in the single substrate and rebaudioside M in the one-pot reactions by these variants at 0.005 g/L SFP loading are shown in Table 18.3.

TABLE 18.3

β1,2GT Shake Flask Variants and RebD and RebM Levels

| SEQ ID NO: (nt/aa) | Amino Acid Differences (Relative to SEQ ID NO: 994) | Increased RebD[a] | Increased RebM[a] | Increased RebM (preincubated)[a] | % Activity Remaining[b] |
|---|---|---|---|---|---|
| 1079/1080 | H164E/Y202I | − | + | ++ | + |
| 1081/1082 | H83Y/Y202I/P233S | + | − | ++ | + |
| 1083/1084 | Y202I/P233S/M248I | + | + | ++ | + |
| 1101/1102 | H164E | + | + | + | − |
| 1095/1096 | H164E/R423L | + | + | − | − |
| 1089/1090 | P233S | ++ | + | − | − |

[a]Levels of increased production were determined relative to the reference polypeptide of SEQ ID NO: 994, and defined as follows: "−" = production less than 0.9-fold that of the reference polypeptide; "+" = production at least 0.9-fold that of the reference but less than 1.1-fold reference polypeptide; and "++" = at least 1.1-fold increased production.

[b]The percent of activity remaining for each variant was determined following 24 h pre-incubation at 71.8° C., relative to the production from each variant following 24 h pre-incubation at 65° C. and is defined as follows: "−" = less than 16% of activity remained following 24 h pre-incubation at 71.8° C.; and "+" = at least 16% activity remained.

In these experiments, three variants in Table 18.3 were significantly improved following preincubation relative to SEQ ID NO: 994 for catalyzing the glucosylation of rebaudioside A to rebaudioside D. The most thermostable variant, SEQ ID NO: 1080, was selected as the starting point for further enzyme engineering.

Example 19

Beta-1,2-ADP-Glycosyltransferase Variants of SEQ ID NO: 1080

In this Example, experiments for evolution and screening of GT polypeptides derived from SEQ ID NO: 1080 for improved glucosylation of steviol glycosides using ADP-glucose are described. Directed evolution of the GT encoded by SEQ ID NO: 1079 was carried out by constructing libraries of variant genes. Libraries recombined mutations associated with improved production identified during the development of the present invention and subjected certain structural features of the enzyme with saturation mutagenesis. These libraries were then plated, grown, and screened using the HTP assay described below to provide another round of engineered GT variant polypeptides with glucosyltransferase activity toward ADP-glucose and steviol glycosides. Thirty-three engineered variants were identified from the combinatorial libraries (Table 19.1), and thirty-eight were identified from the saturation mutagenesis libraries (Table 19.2).

HTP Coupled Assay for Glucose Transfer from Sucrose to ADP to Rebaudioside A 60

Assays were performed on 96-well plates of cleared E. coli culture lysates expressing SEQ ID NO: 1079 variants (i.e., variants of SEQ ID NO: 1080). Lysis buffer volume was 400 µL, and the lysate was diluted 100-fold into 50 mM potassium phosphate, pH 6.0 with 30 g/L (combinatorial libraries) or 10 g/L (saturation mutagenesis retest) rebaudioside A 60%, and pre-incubated for 2 h at 75° C. Assays were then conducted with 10 µL diluted lysate, 0.03 g/L SUS SFP SEQ ID NO: 1822, and 0.1 g/L β-1,3-glycosyltransferase (β1,3GT) SFP SEQ ID NO: 350, in 100 µL reaction volume with 20 g/L rebaudioside A 60% (RebA60) substrate, 0.02 g/L ADP (Amresco, ultra pure grade) co-substrate, and 30 g/L sucrose. The following reaction conditions were used: 50 mM potassium phosphate buffer, pH 6, 60° C. in a THERMOTRON® titre-plate shaker with 300 RPM shaking for 16-18 h. The reactions were solubilized by 20× dilution into water, quenched by 5× dilution into acetonitrile with 0.2% formic acid, precipitated by centrifugation, and diluted 20× into water for analysis as described above. The resulting engineered variants with glucosyltransferase activity on RebA60 are listed in Table 19.1 and 19.2. Shake-flask scale cultures were grown, lysed, and lyophilized to powder for variants listed in Table 19.3.

TABLE 19.1

β1,2 GT Combinatorial Variants and RebM Levels

| SEQ ID NO: (nt/aa) | Amino Acid Differences (Relative to SEQ ID NO: 1080) | Increased RebM[a] |
|---|---|---|
| 1167/1168 | S9L/A73R/L116I/E165P/N286G/K422A | +++ |
| 1169/1170 | D389E/K422A | +++ |
| 1171/1172 | E165P | +++ |
| 1173/1174 | A73R/L116I/N286G | +++ |
| 1175/1176 | N286G/K422A | +++ |
| 1177/1178 | A73R/N286G/D389E | +++ |
| 1179/1180 | A73R/N286G/K422A | ++ |
| 1181/1182 | L116I/E165P/N286G/K422A | ++ |
| 1183/1184 | A73R/K422T | ++ |
| 1185/1186 | A73R/N286G/K422T | ++ |
| 1187/1188 | G7T/E165P | ++ |
| 1189/1190 | N286G | ++ |
| 1191/1192 | A73R/L116I/E165P/N286G/D389E | ++ |
| 1193/1194 | A73R | ++ |
| 1195/1196 | G7T/S9L/A73R/E165P/N286G | ++ |
| 1197/1198 | G7T/L116I/E165P/N286G | ++ |
| 1199/1200 | G7T/S9L/E165P/N286G | + |
| 1201/1202 | S54M/S406M | + |
| 1203/1204 | L116I/E165P | + |
| 1205/1206 | E165P/D389E | + |
| 1207/1208 | K422T | + |
| 1209/1210 | L116I | + |
| 1211/1212 | S9L/N286G/D389E | + |
| 1213/1214 | E165P/N286G | + |
| 1215/1216 | A73R/L116I/N286G/K422A | + |
| 1217/1218 | G7T/S9L/K422A | + |
| 1219/1220 | L116I/D389E | + |
| 1221/1222 | N115A | + |
| 1223/1224 | E165P/D389E/K422T | + |
| 1225/1226 | A73R/E165P/N286G | + |
| 1227/1228 | Y84L | + |
| 1229/1230 | S54M | + |
| 1231/1232 | S54L/Y84L | + |

[a]Levels of increased production were determined relative to the reference polypeptide of SEQ ID NO: 1080, and defined as follows: "+" = production at least 1.37-fold that of the reference but less than 1.65-fold reference polypeptide; "++" = at least 1.65-fold increased production but less than 2.02-fold; and "+++" = at least 2.02-fold increased production.

TABLE 19.2

β1,2GT Saturation Mutagenesis Variants and RebM Levels

| SEQ ID NO: (nt/aa) | Amino Acid Differences (Relative to SEQ ID NO: 1080) | Increased RebM[a] |
|---|---|---|
| 1233/1234 | Q441R | +++ |
| 1235/1236 | V385P | +++ |
| 1237/1238 | G395D | +++ |
| 1239/1240 | F185L/T190P | +++ |
| 1241/1242 | Q441S | +++ |
| 1243/1244 | Q399R | +++ |
| 1245/1246 | Q441A | +++ |
| 1247/1248 | G395H | +++ |
| 1249/1250 | N445R | ++ |
| 1251/1252 | N447A | ++ |
| 1253/1254 | N445K | ++ |
| 1255/1256 | Y449H | ++ |
| 1257/1258 | V385S | ++ |
| 1259/1260 | G395A | ++ |
| 1261/1262 | N302H | ++ |
| 1263/1264 | G395N | ++ |
| 1265/1266 | N257H | ++ |
| 1267/1268 | Q441K | ++ |
| 1269/1270 | N447S | ++ |
| 1271/1272 | N447R | + |
| 1273/1274 | N302R | + |
| 1275/1276 | V385M | + |
| 1277/1278 | C219L | + |
| 1279/1280 | T220A | + |
| 1281/1282 | N302T | + |
| 1283/1284 | N302L | + |
| 1285/1286 | P255R | + |
| 1287/1288 | Q441L | + |
| 1289/1290 | N447V | + |
| 1291/1292 | N302A | + |
| 1293/1294 | Y449A | + |
| 1295/1296 | T409L | + |
| 1297/1298 | A434I | + |
| 1299/1300 | G395S/E437L | + |

TABLE 19.2-continued

β1,2GT Saturation Mutagenesis Variants and RebM Levels

| SEQ ID NO: (nt/aa) | Amino Acid Differences (Relative to SEQ ID NO: 1080) | Increased RebM[a] |
|---|---|---|
| 1301/1302 | I412K | + |
| 1303/1304 | K416N | + |
| 1305/1306 | L401V | + |
| 1307/1308 | Y449T | + |

[a]Levels of increased production were determined relative to the reference polypeptide of SEQ ID NO: 1080, and defined as follows: "+" = production at least 1.11-fold that of the reference but less than 1.22-fold reference polypeptide; "++" = at least 1.22-fold increased production but less than 1.40-fold; and "+++" = at least 1.40-fold increased production.

Shake Flask Powder Characterization Assay and Analysis for Glucosyl Transfer from Sucrose to ADP to Rebaudioside A 60

Shake flask powders (SFP) were reconstituted to a concentration of 4 g/L and diluted to 0.0013-0.04 g/L in 100 μL total reaction volume containing 50 mM potassium phosphate buffer, pH 6, 20 g/L RebA97 or steviol glycoside 95% (single substrate) or RebA60 (one-pot), 0.02 g/L ADP, 20 (single substrate) or 30 g/L (one-pot) sucrose, 0.03 g/L SUS SFP SEQ ID NO: 1822, and, for the one-pot reaction only, 0.1 g/L β-1,3-glycosyltransferase (β1,3GT) SFP SEQ ID NO: 440. The reactions were performed at 60° C. in a THERMOTRON® titre-plate shaker at 300 RPM for 4 h (single substrate) or 16-18 h (one-pot). One set of SFP dilutions was pre-incubated for 2 h at 75° C. in 50 mM potassium phosphate buffer, pH 6 with 30 g/L rebaudioside A 60%, while another set was not pre-incubated. The reactions were solubilized by 20× dilution with water, quenched by 5× dilution with acetonitrile with 0.2% formic acid, cleared by centrifugation, and diluted 20× with water for analysis. Glycosylated products were detected by SPE-QQQ as described in Example 5, Table 5.1. To assess thermostability, similar one-pot RebA60 reactions were also performed with 10 μL of crude clarified lysate that had been diluted 70× in 50 mM potassium phosphate buffer, pH 6 with 30 g/L RebA60, and incubated 24 h at 71.8° C. The thermostability results and production levels of rebaudioside D and rebaudioside E in the single substrate and rebaudioside M in the one-pot reactions by these variants at 0.01 g/L SFP loading are shown in Table 19.3.

In these experiments, two variants in Table 19.3 had similar activity relative to SEQ ID NO: 1080 without pre-incubation and greater activity with pre-incubation. The more thermostable variant, SEQ ID NO: 1216, was selected as the starting point for further enzyme engineering.

Example 20

Beta-1,2-ADP-Glycosyltransferase Variants of SEQ ID NO: 1216

In this Example, experiments for evolution and screening of GT polypeptides derived from SEQ ID NO: 1216 for improved glucosylation of steviol glycosides using ADP-glucose are described. Directed evolution of the GT encoded by SEQ ID NO: 1215 was carried out by constructing libraries of variant genes. Libraries recombined mutations associated with improved production identified during the development of the present invention and subjected certain structural features of the enzyme with saturation mutagenesis. These libraries were then plated, grown, and screened using the HTP assay described below to provide another round of engineered GT variant polypeptides with glucosyltransferase activity toward ADP-glucose and steviol glycosides. Ninety-one engineered variants were identified from the combinatorial libraries (Table 20.1), and eleven were identified from the saturation mutagenesis libraries (Table 20.2).

HTP Coupled Assay for Glucose Transfer from Sucrose to ADP to Rebaudioside A 60

Assays were performed on 96-well plates of cleared E. coli culture lysates expressing SEQ ID NO: 1215 variants (i.e., variants of SEQ ID NO: 1216). Lysis buffer volume was 400 μL, and the lysate was diluted 60-fold into 50 mM potassium phosphate, pH 6.0 with 60 g/L (combinatorial libraries) or 80 g/L (saturation mutagenesis retest) rebaudioside A 60%, and pre-incubated for 2 h at 75° C. Assays were then conducted with 10 μL diluted lysate, 0.03 g/L SUS SFP SEQ ID NO: 2182, and 0.1 g/L β-1,3-glycosyltransferase (β1,3GT) SFP SEQ ID NO: 520, in 100 μL reaction volume with 20 g/L rebaudioside A 60% (RebA60) substrate, 0.01 g/L ADP (Amresco, ultra pure grade) co-substrate, and 30 g/L sucrose. The following reaction conditions

TABLE 19.3

β1,2GT Shake Flask Variants and RebD and RebM Levels

| SEQ ID NO: (nt/aa) | Amino Acid Differences (Relative to SEQ ID NO: 1080) | Increased RebD[a] | Increased RebE[a] | Increased RebM[a] | Increased RebM (pre-incubated)[a] | % Activity Remaining[b] |
|---|---|---|---|---|---|---|
| 1167/1168 | S9L/A73R/L116I/E165P/N286G/K422A | − | − | − | ++ | ++ |
| 1215/1216 | A73R/L116I/N286G/K422A | + | + | + | ++ | ++ |
| 1175/1176 | N286G/K422A | − | + | + | ++ | + |
| 1181/1182 | L116I/E165P/N286G/K422A | + | + | − | +++ | + |
| 1229/1230 | S54M | + | ++ | − | +++ | + |
| 1231/1232 | S54L/Y84L | − | + | − | ++ | + |
| 1201/1202 | S54M/S406M | − | + | − | ++ | + |

[a]Levels of increased production were determined relative to the reference polypeptide of SEQ ID NO: 1080, and defined as follows: "−" = production less than 0.9-fold that of the reference polypeptide; "+" = production at least 0.9-fold that of the reference but less than 1.1-fold reference polypeptide; "++" = at least 1.1-fold but less than 1.5-fold increased production; and "+++" = at least 1.5-fold increased production.
[b]The percent of activity remaining for each variant was determined following 24 h pre-incubation at 71.8° C., relative to the production from each variant following 24 h pre-incubation at 65° C. and is defined as follows: "+" = less than 35% of activity remained following 24 h pre-incubation at 71.8° C.; and "++" = at least 35% activity remained.

were used: 50 mM potassium phosphate buffer, pH 6, 60° C. in a THERMOTRON® titre-plate shaker with 300 RPM shaking for 16-18 h. The reactions were solubilized by 20× dilution into water, quenched by 5× dilution into acetonitrile with 0.2% formic acid, precipitated by centrifugation, and diluted 20× into water for analysis as described above. The resulting engineered variants with glucosyltransferase activity on RebA60 are listed in Table 20.1 and 20.2. Shake-flask scale cultures were grown, lysed, and lyophilized to powder for variants listed in Table 20.3.

TABLE 20.1

β1,2 GT Combinatorial Variants and RebM Levels

| SEQ ID NO: (nt/aa) | Amino Acid Differences (Relative to SEQ ID NO: 1216) | Increased RebM[a] |
|---|---|---|
| 1309/1310 | F185L/T190P/V385S/D389E/Q441R/N445K/N447S | +++ |
| 1311/1312 | S54M/D389E/G395D/Q399R/N447A/Y449H | +++ |
| 1313/1314 | S54M/F185L/T190P/C219L/N257H/N302R/V385P/D389E/G395H/N445K/N447A/Y449H | +++ |
| 1315/1316 | S54M/F185L/T190P/V385P/N447A/Y449H | +++ |
| 1317/1318 | V385S/D389E | +++ |
| 1319/1320 | T190P/N257H/V385S/D389E/N445K/N447A | +++ |
| 1321/1322 | N257H/D389E/G395D/Q399R/N445K/Y449H | +++ |
| 1323/1324 | S54M/N257H/Q441R/Y449H | +++ |
| 1325/1326 | F185L/C219L/N257H/Q399R/N445R/N447A | +++ |
| 1327/1328 | S54M/F185L/V385S/G395D/Q399R/N445R/N447A/Y449H | +++ |
| 1329/1330 | S54M/T190P/N257H/V385S/D389E | +++ |
| 1331/1332 | S54M/T190P/N302H/D389E/G395D/Q399R/N445K/N447S | +++ |
| 1333/1334 | S54M/C219L/N302R/G395H/Q441S/N445R/N447A | +++ |
| 1335/1336 | S54M/N257H/Q441R/N447A | +++ |
| 1337/1338 | S54M/F185L/T190P/D389E/Q441R/N445R/N447A/Y449H | +++ |
| 1339/1340 | F185L/T190P/N257H/N302R/G395D/Q441S/N445R/N447S | +++ |
| 1341/1342 | T190P/N257H/D389E/G395R/Q441R/N445R/N447A | +++ |
| 1343/1344 | F185L/T190P/G395D/Q399R | +++ |
| 1345/1346 | S54M/F185L/V385S/D389E/G395D/Q441R/N445K/Y449H | ++ |
| 1347/1348 | F185L/T190P/C219L/N257H/D389E/G395A/N445K/N447A | ++ |
| 1349/1350 | S54M/V385P | ++ |
| 1351/1352 | N257H/D389E/Q399R | ++ |
| 1353/1354 | S54M/T190P/G395A | ++ |
| 1355/1356 | S54M/F185L/T190P | ++ |
| 1357/1358 | S54M/V385P/D389E/Q441R/N445K/N447A/Y449H | ++ |
| 1359/1360 | S54M/F185L/T190P/C219L/D389E/G395H/Q399R/Q441S/N445K/N447A/Y449H | ++ |
| 1361/1362 | S54M/F185L/T190P/C219L/V385S | ++ |
| 1363/1364 | S54M/N257H | ++ |
| 1365/1366 | S54M/F185L/T190P/D389E/G395H | ++ |
| 1367/1368 | F185L/N302R/G395H/Q399R/Q441R/N445K/N447S/Y449H | ++ |
| 1369/1370 | F185L/T190P/G395H/Q399R | ++ |
| 1371/1372 | S54M/F185L/N302R/V385S/Q399R/N445R/N447A | ++ |
| 1373/1374 | F185L/G395D/Q399R/Q441R/N445R/N447A | ++ |
| 1375/1376 | S54M/F185L/T190P/N302R/G395H/Q399R | ++ |
| 1377/1378 | S54M/F185L/T190P/G395D/Q399R/Q441R/N445K/N447A/Y449H | ++ |
| 1379/1380 | S54M/N257H/D389E | ++ |
| 1381/1382 | F185L/T190P/D389E/N447S/Y449H | ++ |
| 1383/1384 | C219L/N257H/G395H | ++ |
| 1385/1386 | S54M/T190P/G395H/N445K/N447A | ++ |
| 1387/1388 | T190P/N257H/V385S/G395D | ++ |
| 1389/1390 | S54M/T190P/V385S/D389E/G395H/Q441S/N445R | ++ |
| 1391/1392 | S54M/N257H/V385S/Y449H | ++ |
| 1392/1394 | T190P/C219L/N302H/V385P/Q399R/N445R | ++ |
| 1395/1396 | S54M | ++ |
| 1397/1398 | S54M/T190P/N257H/N302H/Q399R | ++ |
| 1399/1400 | S54M/N257H/Q399R | + |
| 1401/1402 | S54M/F185L/C219L/D389E | + |
| 1403/1404 | S54M/T190P/C219L/N257H/N302H | + |
| 1405/1406 | N257H/V385P/D389E/Q399R | + |
| 1407/1408 | S54M/T190P/V385P/N445R/N447A/Y449H | + |
| 1409/1410 | S54M/T190P/N257H | + |
| 1411/1412 | S54M/T190P/N302R/D389E | + |
| 1413/1414 | S54M/C219L/V385P/D389E/G395D/Q441R/N445K/N447A | + |
| 1415/1416 | C219L/G395H | + |
| 1417/1418 | S54M/F185L/T190P/N302H | + |
| 1719/1420 | G395D/Q399R | + |
| 1421/1422 | S54M/T190P/N257H/K309N/V385S/D389E/G395D/Q399R/N445K | + |
| 1423/1424 | S54M/F185L/T190P/C219L/V385S/D389E/G395D/Q399R/Q441R/N445R/N447A/Y449H | + |
| 1425/1426 | V385S/G395D | + |
| 1427/1428 | S54M/F185L/T190P/C219L/V385S/G395A/Q399R/Q441R/N445K/N447A/Y449H | + |
| 1429/1430 | S54M/T190P/C219L/N257H/G395H/N445R/N447A/Y449H | + |
| 1431/1432 | S54M/F185L/T190P/D389E/N445K | + |

TABLE 20.1-continued

β1,2 GT Combinatorial Variants and RebM Levels

| SEQ ID NO: (nt/aa) | Amino Acid Differences (Relative to SEQ ID NO: 1216) | Increased RebM[a] |
|---|---|---|
| 1433/1434 | N257H/D389E/G395D/Q399R/N445K/N447A | + |
| 1435/1436 | T190P/N257H/Q399R/N447A/Y449H | + |
| 1467/1438 | F185L/T190P/N257H/D389E/G395H/Q399R/Q441S/N447S/Y449H | + |
| 1439/1440 | F185L/N257H/V385S/G395A/Q399R/N445R/N447A | + |
| 1441/1442 | F185L/T190P/N257H/D389E/G395A | + |
| 1443/1444 | T190P/N257H/N302H/V385P/Q399R | + |
| 1445/1446 | T190P/D389E | + |
| 1447/1448 | D389E/G395D/N445R/N447S | + |
| 1449/1450 | Q399R | + |
| 1451/1452 | S54M/T190P/V385P/G395D | + |
| 1453/1454 | S54M/F185L/D389E/G395D/N445K/N447A | + |
| 1455/1456 | N302H/D389E/G395H/N445R | + |
| 1457/1458 | S54M/N302H/V385S/Q399R/Q441S/N445R/Y449H | + |
| 1459/1460 | S54M/F185L/N257H/D389E/Q441S/N445R/N447A/Y449H | + |
| 1461/1462 | F185L/T190P/N257H/V385P/D389E/Q399R | + |
| 1463/1464 | S54M/F185L/T190P/C219L/V385P/N445R/N447A | + |
| 1465/1466 | T190P/C219L/N257H/V385S/D389E/Q441S/N445R/N447A/Y449H | + |
| 1467/1468 | T190P/N302H/V385P/D389E/G395D/Q399R/Q441S/N445K/N447S | + |
| 1469/1470 | C219L/N257H/V385S/D389E/G395D/Q441R/N447A/Y449H | + |
| 1471/1472 | S54M/T190P/N257H/G395D/N445K/Y449H | + |
| 1473/1474 | T190P/N257H/V385P/D389E/Q399R | + |
| 1475/1476 | T190P/N257H/V385S/Q441S/N445R/N447S/Y449H | + |
| 1477/1478 | F185L/T190P/N257H/V385P/Q399R/N445R/N447A | + |
| 1479/1480 | S54M/N302H/V385P/Q399R/Q441S/N445K/N447S | + |
| 1481/1482 | C219L/V385S/D389E/Q399R/N445R/Y449H | + |

[a]Levels of increased production were determined relative to the reference polypeptide of SEQ ID NO: 1216, and defined as follows: "+" = production at least 1.87-fold that of the reference but less than 2.17-fold reference polypeptide; "++" = at least 2.17-fold increased production but less than 2.42-fold; and "+++" = at least 2.42-fold increased production.

TABLE 20.2

β1,2GT Saturation Mutagenesis Variants and RebM Levels

| SEQ ID NO: (nt/aa) | Amino Acid Differences (Relative to SEQ ID NO: 1216) | Increased RebM[a] |
|---|---|---|
| 1491/1492 | I341L | +++ |
| 1493/1494 | N157Q | +++ |
| 1495/1496 | V278L | ++ |
| 1497/1498 | N108E | ++ |
| 1499/1500 | M181L | ++ |
| 1501/1502 | E188L | + |
| 1503/1504 | A293V | + |
| 1505/1506 | G96K | + |
| 1507/1508 | R14T | + |
| 1509/1510 | H5S | + |
| 1511/1512 | G96P | + |

[a]Levels of increased production were determined relative to the reference polypeptide of SEQ ID NO: 1216, and defined as follows: "+" = production at least 1.17-fold that of the reference but less than 1.40-fold reference polypeptide; "++" = at least 1.40-fold increased production but less than 1.83-fold; and "+++" = at least 1.83-fold increased production.

Shake Flask Powder Characterization Assay and Analysis for Glucosyl Transfer from Sucrose to ADP to Rebaudioside A 60

Shake flask powders (SFP) were reconstituted to a concentration of 4 g/L and diluted to 0.0013-0.04 g/L in 100 μL total reaction volume containing 50 mM potassium phosphate buffer, pH 6, 20 g/L RebA97 or steviol glycoside 95% (single substrate) or RebA60 (one-pot), 0.02 g/L ADP, 20 (single substrate) or 30 g/L (one-pot) sucrose, 0.03 g/L SUS SFP SEQ ID NO: 2182, and, for the one-pot reaction only, 0.1 g/L β-1,3-glycosyltransferase (β1,3GT) SFP SEQ ID NO: 520. The reactions were performed at 60° C. in a THERMOTRON® titre-plate shaker at 300 RPM for 4 h (single substrate) or 16-18 h (one-pot). One set of SFP dilutions was pre-incubated for 2 h at 75° C. in 50 mM potassium phosphate buffer, pH 6 with 80 g/L rebaudioside A 60%, while another set was not pre-incubated. The reactions were solubilized by 20× dilution with water, quenched by 5× dilution with acetonitrile with 0.2% formic acid, cleared by centrifugation, and diluted 20× with water for analysis. Glycosylated products were detected by SPE-QQQ as described in Example 5, Table 5.1. To assess thermostability, similar one-pot RebA60 reactions were also performed with 10 μL of crude clarified lysate that had been diluted 70× in 50 mM potassium phosphate buffer, pH 6 with 100 g/L RebA60, and incubated 24 h at 71.8° C. The thermostability results and production levels of rebaudioside D and rebaudioside E in the single substrate and rebaudioside M in the one-pot reactions by these variants at 0.005 g/L SFP loading are shown in Table 20.3.

TABLE 20.3

β1,2GT Shake Flask Variants and RebD and RebM Levels

| SEQ ID NO: (nt/aa) | Amino Acid Differences (Relative to SEQ ID NO: 1216) | Increased RebD[a] | Increased RebE[a] | Increased RebM[a] | Increased RebM (pre-incubated)[a] | % Activity Remaining[b] |
|---|---|---|---|---|---|---|
| 1315/1316 | S54M/F185L/T190P/V385P/N447A/Y449H | + | + | ++ | +++ | ++ |

TABLE 20.3-continued

β1,2GT Shake Flask Variants and RebD and RebM Levels

| SEQ ID NO: (nt/aa) | Amino Acid Differences (Relative to SEQ ID NO: 1216) | Increased RebD[a] | Increased RebE[a] | Increased RebM[a] | Increased RebM (pre-incubated)[a] | % Activity Remaining[b] |
|---|---|---|---|---|---|---|
| 1487/1488 | S54M/T190P/N257H/ N302R/V385P/ G395A/Q399R | + | + | + | +++ | +++ |
| 1379/1380 | S54M/N257H/D389E | + | + | + | ++ | + |
| 1331/1332 | S54M/T190P/N302H/ D389E/G395D/ Q399R/N445K/N447S | – | + | + | +++ | + |
| 1313/1314 | S54M/F185L/T190P/ C219L/N257H/ N302R/V385P/D389E/ G95H/N445K/ N447A/Y449H | – | + | + | +++ | ++ |
| 1391/1392 | S54M/N257H/V385S/ Y449H | + | + | ++ | ++ | + |
| 1311/1312 | S54M/D389E/G395D/ Q399R/N447A/ Y449H | + | + | + | ++ | + |

[a]Levels of increased production were determined relative to the reference polypeptide of SEQ ID NO: 1216, and defined as follows: "–" = production less than 0.9-fold that of the reference polypeptide; "+" = production at least 0.9-fold that of the reference but less than 1.1-fold reference polypeptide; "++" = at least 1.1-fold but less than 1.8-fold increased production; and "+++" = at least 1.8-fold increased production relative to reference polypeptide.
[b]The percent of activity remaining for each variant was determined following 24 h pre-incubation at 71.8° C., relative to the production from each variant following 24 h pre-incubation at 65° C. and is defined as follows: "+" = at least 17% but less than 33% activity remained following 24 h pre-incubation at 71.8° C.; "++" = at least 33% but less than 35% activity remained; and "+++" = at least 35% activity remained.

In these experiments, all seven variants in Table 20.3 were improved relative to SEQ ID NO: 1216 with pre-incubation. The more thermostable variant, SEQ ID NO: 1488, was selected as the starting point for further enzyme engineering.

Example 21

Beta-1,2-ADP-Glycosyltransferase Variants of SEQ ID NO: 1488

In this Example, experiments for evolution and screening of GT polypeptides derived from SEQ ID NO: 1488 for improved glucosylation of steviol glycosides using ADP-glucose are described. Directed evolution of the GT encoded by SEQ ID NO: 1487 was carried out by constructing libraries of variant genes. Libraries recombined mutations associated with improved production identified during the development of the present invention and subjected certain structural features of the enzyme with saturation mutagenesis. These libraries were then plated, grown, and screened using the HTP assay described below to provide another round of engineered GT variant polypeptides with glucosyltransferase activity toward ADP-glucose and steviol glycosides. Twenty-six engineered variants were identified from the combinatorial libraries (Table 21.1), and seventeen were identified from the saturation mutagenesis libraries (Table 21.2).

HTP Coupled Assay for Glucose Transfer from Sucrose to ADP to Rebaudioside A 60

Assays were performed on 96-well plates of cleared E. coli culture lysates expressing SEQ ID NO: 1487 variants (i.e., variants of SEQ ID NO:1488). Lysis buffer volume was 400 μL, and the lysate was diluted 60 or 100-fold into 50 mM potassium phosphate, pH 6.0 with 100 g/L rebaudioside A 60%, and pre-incubated for 2 h at 75° C. Assays were then conducted with 10 μL diluted lysate, 0.075 g/L SUS SFP SEQ ID NO: 2182, and 0.25 g/L β-1,3-glycosyltransferase (β1,3GT) SFP SEQ ID NO: 626, in 100 μL, reaction volume with 50 g/L rebaudioside A 60% (RebA60) substrate, 0.025 g/L ADP (Amresco, ultra pure grade) co-substrate, and 75 g/L sucrose. The following reaction conditions were used: 50 mM potassium phosphate buffer, pH 6, 60° C. in a THERMOTRON® titre-plate shaker with 300 RPM shaking for 16-18 h. The reactions were solubilized by 50× dilution into water, quenched by 5× dilution into acetonitrile with 0.2% formic acid, precipitated by centrifugation, and diluted 20× into water for analysis as described above. The resulting engineered variants with glucosyltransferase activity on RebA60 are listed in Table 21.1 and 21.2. Shake-flask scale cultures were grown, lysed, and lyophilized to powder for variants listed in Table 21.3.

TABLE 21.1

β1,2 GT Combinatorial Variants and RebM Levels

| SEQ ID NO: (nt/aa) | Amino Acid Differences (Relative to SEQ ID NO: 1488) | Increased RebM[a] |
|---|---|---|
| 1513/1514 | R14T/G96P/N108E/M181L/I341L | +++ |
| 1515/1516 | E188L | +++ |
| 1517/1518 | V42T/E188L/I341L | +++ |
| 1519/1520 | M181L | +++ |
| 1521/1522 | G96P/N108E/E188L/I341L | +++ |
| 1523/1524 | R14T/G96K | ++ |
| 1525/1526 | R14T/G96K/N108E/V133I | ++ |
| 1527/1528 | R14T/N108E/N157Q/E188L | ++ |
| 1529/1530 | R14T/N51V/G96P/N157Q/I341L | ++ |
| 1531/1532 | R14T/V42T/I341L | ++ |
| 1533/1534 | G96K/E188L | ++ |
| 1535/1536 | R14T/V42T/N51V/N157Q/I341L | ++ |
| 1537/1538 | R14T/N51V/N108E | ++ |
| 1539/1540 | G96P/N108E/E188L | + |
| 1541/1542 | R14T/V42T/N51V/N108E/M181L | + |
| 1543/1544 | R14T/N51V/G96K/N157Q | + |
| 1545/1546 | R14T/V278L | + |
| 1547/1548 | R14T/N51V/I341L | + |
| 1549/1550 | R14T/N108E/N157Q | + |
| 1551/1552 | G96P/N108E/M181L/A293V | + |
| 1553/1554 | R14T/G96K/N108E/E188V | + |
| 1555/1556 | R14T/G96K/I341L | + |

TABLE 21.1-continued

β1,2 GT Combinatorial Variants and RebM Levels

| SEQ ID NO: (nt/aa) | Amino Acid Differences (Relative to SEQ ID NO: 1488) | Increased RebM[a] |
|---|---|---|
| 1557/1558 | R14T/N157Q/M181L/V278L | + |
| 1559/1560 | V42T/G96P/N157Q/I341L | + |
| 1561/1562 | A293V | + |
| 1563/1564 | R14T/N51V/G96P/I341L | + |

[a]Levels of increased production were determined relative to the reference polypeptide of SEQ ID NO: 1488, and defined as follows: "+" = production at least 1.11-fold that of the reference but less than 1.21-fold reference polypeptide; "++" = at least 1.21-fold increased production but less than 1.35-fold; and "+++" = at least 1.35-fold increased production.

TABLE 21.2

β1,2 GT Saturation Mutagenesis Variants and RebM Levels

| SEQ ID NO: (nt/aa) | Amino Acid Differences (Relative to SEQ ID NO: 1488) | Increased RebM[a] | Increased RebM (A60 preincubated)[a] |
|---|---|---|---|
| 1565/1566 | H324K | +++ | + |
| 1567/1568 | A196V | +++ | ++ |
| 1569/1570 | P197V | ++ | + |
| 1571/1572 | Y268A | ++ | + |
| 1573/1574 | A196P | ++ | + |
| 1575/1576 | G201P | ++ | +++ |
| 1577/1578 | N199Q | + | + |
| 1579/1580 | T187K | + | + |
| 1581/1582 | H324R | + | + |
| 1583/1584 | A196M | + | ++ |
| 1585/1586 | S147F | + | +++ |
| 1587/1588 | Q198F | + | +++ |
| 1589/1590 | N199G | + | + |
| 1591/1592 | Q198A | + | ++ |
| 1593/1594 | L144V | + | ++ |
| 1595/1596 | L122V | + | ++ |
| 1597/1598 | N199S | + | + |

[a]Levels of increased production were determined relative to the reference polypeptide of SEQ ID NO: 1488, and defined as follows: "+" = production at least that of the reference but less than 1.22-fold reference polypeptide; "++" = at least 1.22-fold increased production but less than 1.45-fold; and "+++" = at least 1.45-fold increased production.

Shake Flask Powder Characterization Assay and Analysis for Glucosyl Transfer from Sucrose to ADP to Rebaudioside A 60

Shake flask powders (SFP) were reconstituted to a concentration of 4 g/L and diluted to 0.0013-0.04 g/L in 100 µL total reaction volume containing 50 mM potassium phosphate buffer, pH 6. Single substrate reactions consisted of 20 g/L RebA97, 0.02 g/L ADP, 20 g/L sucrose, and 0.03 g/L SUS SFP SEQ ID NO: 2182. One pot reactions consisted of 50 g/L RebA60, 0.025 g/L ADP, 75 g/L sucrose, 0.075 g/L SUS SFP SEQ ID NO: 2182, and 0.25 g/L β-1,3-glycosyltransferase (β1,3GT) SFP SEQ ID NO: 626. The reactions were performed at 60° C. in a THERMOTRON® titre-plate shaker at 300 RPM for 4 h (single substrate) or 16-18 h (one-pot). One set of SFP dilutions was pre-incubated for 2 h at 75° C. in 50 mM potassium phosphate buffer, pH 6 with 100 g/L rebaudioside A 60%, while another set was not pre-incubated. The reactions were solubilized by diluting to 1 g/L substrate in water, quenched by 5× dilution with acetonitrile with 0.2% formic acid, cleared by centrifugation, and diluted 20× with water for analysis. Glycosylated products were detected by SPE-QQQ as described in Example 5, Table 5.1. To assess thermostability, similar one-pot RebA60 reactions were also performed with 10 µL of crude clarified lysate that had been diluted 70× in 50 mM potassium phosphate buffer, pH 6 with 100 g/L RebA60, and incubated 24 h at 71.8° C. The thermostability results and production levels of rebaudioside D and rebaudioside E in the single substrate and rebaudioside M in the one-pot reactions by these variants at 0.005 g/L SFP loading are shown in Table 21.3.

TABLE 21.3

β1,2 GT Shake Flask Variants and RebD and RebM Levels

| SEQ ID NO: (nt/aa) | Amino Acid Differences (Relative to SEQ ID NO: 1488) | Increased RebD[a] | Increased RebM[a] | Increased RebM (pre-incubated)[a] | % Activity Remaining[b] |
|---|---|---|---|---|---|
| 1523/1524 | R14T/G96K | − | − | + | + |
| 1525/1526 | R14T/G96K/N108E/V133I | − | − | + | + |
| 1515/1516 | E188L | ++ | ++ | + | + |
| 1513/1514 | R14T/G96P/N108E/M181L/I341L | − | − | ++ | + |
| 1531/1532 | R14T/V42T/I341L | − | − | ++ | + |
| 1523/1524 | R14T/G96K | − | − | + | + |
| 1525/1526 | R14T/G96K/N108E/V133I | − | − | + | + |

[a]Levels of increased production were determined relative to the reference polypeptide of SEQ ID NO: 1488, and defined as follows: "−" = production less than 0.95-fold that of the reference polypeptide; "+" = production at least 0.95-fold that of the reference but less than 1.05-fold reference polypeptide; and "++" = at least 1.05-fold increased production.
[b]The percent of activity remaining for each variant was determined following 24 h pre-incubation at 71.8° C., relative to the production from each variant following 24 h pre-incubation at 65° C. and is defined as follows: "+" = at least 17% and less than 23% of activity remained following 24 h pre-incubation at 71.8° C.

In these experiments, one variant in Table 21.3 performed similarly or better than SEQ ID NO: 1488 under the single substrate, one-pot with and without pre-incubation, and 24 h thermostability conditions. This variant, SEQ ID NO: 1516, was selected as the starting point for further enzyme engineering.

Example 22

Beta-1,2-ADP-Glycosyltransferase Variants of SEQ ID NO: 1516

In this Example, experiments for evolution and screening of GT polypeptides derived from SEQ ID NO: 1516 for improved glucosylation of steviol glycosides using ADP-glucose are described. Directed evolution of the GT encoded by SEQ ID NO: 1516 was carried out by constructing libraries of variant genes. Libraries recombined mutations associated with improved production identified during the development of the present invention. These libraries were then plated, grown, and screened using the HTP assay described below to provide another round of engineered GT variant polypeptides with glucosyltransferase activity toward ADP-glucose and steviol glycosides. Twenty-one engineered variants were identified from the combinatorial libraries (Table 22.1).

HTP Coupled Assay for Glucose Transfer from Sucrose to ADP to Rebaudioside A 60

Assays were performed on 96-well plates of cleared *E. coli* culture lysates expressing SEQ ID NO: 1515 variants (i.e., variants of SEQ ID NO: 1516). Lysis buffer volume was 400 μL, and the lysate was diluted 33-fold into 50 mM potassium phosphate, pH 6.0 with and without 100 g/L rebaudioside A 60%, and the plates with 100 g/L RebA60 were pre-incubated for 2 h at 75° C. Assays were then conducted with 10 μL, diluted lysate, 0.075 g/L SUS SFP SEQ ID NO: 2322, and 0.25 g/L β-1,3-glycosyltransferase (β1,3GT) SFP SEQ ID NO: 678, in 100 μL reaction volume with 50 g/L rebaudioside A 60% (RebA60) substrate, 0.025 g/L ADP (Amresco, ultra pure grade) co-substrate, and 75 g/L sucrose. The following reaction conditions were used: 50 mM potassium phosphate buffer, pH 6, 60° C. in a THERMOTRON® titre-plate shaker with 300 RPM shaking for 16-18 h. The reactions were solubilized by 50× dilution into water, quenched by 5× dilution into acetonitrile with 0.2% formic acid, precipitated by centrifugation, and diluted 20× into water for analysis as described above. The resulting engineered variants with glucosyltransferase activity on RebA60 are listed in Table 22.1. Shake-flask scale cultures were grown, lysed, and lyophilized to powder for variants listed in Table 22.2.

TABLE 22.1

β1,2 GT Combinatorial Variants and RebM Levels

| SEQ ID NO: (nt/aa) | Amino Acid Differences (Relative to SEQ ID NO: 1516) | Increased RebM[a] | Increased RebM (A60 preincubated)[a] |
|---|---|---|---|
| 1599/1600 | L188E/Q198A/N199Q/Y268A | + | +++ |
| 1601/1602 | L188E/H324K | ++ | ++ |
| 1603/1604 | L188E/A196V/G201P | + | +++ |
| 1605/1606 | F152Y/L188E/A196V/Q198A/N199Q/H324K | + | +++ |
| 1607/1608 | L188E/A196V/Q198A/N199Q/G201P | + | +++ |
| 1609/1610 | L188E/A196V/Q198F/G201P | + | +++ |
| 1611/1612 | L188E/G201P | ++ | +++ |
| 1613/1614 | F152Y/L188E/A196V/G201P/H324K | − | +++ |
| 1615/1616 | L188E/Q198F/N199Q/G201P/H324K | − | ++ |
| 1617/1618 | S147F/L188E/A196V/G201P | − | ++ |
| 1619/1620 | L188E/Q198A/H324K | + | ++ |
| 1621/1622 | L188E/N199Q/G201P | + | ++ |
| 1623/1624 | F152Y/L188E/A196V/N199Q | + | ++ |
| 1625/1626 | L188E | + | ++ |
| 1627/1628 | L188E/A196V/Q198A/H324K | + | ++ |
| 1629/1630 | L188E/A196V/Q198F/N199Q/G201P/H324K | + | ++ |
| 1631/1632 | F152Y/L188E | + | ++ |
| 1633/1634 | L188E/G201P/H324K | + | ++ |
| 1635/1636 | F152Y/T187K/L188E/H324K | + | ++ |
| 1637/1638 | L188E/Q198A/G201P/H324K | − | ++ |
| 1639/1640 | F152Y/L188E/H324K | + | ++ |

[a]Levels of increased production were determined relative to the reference polypeptide of SEQ ID NO: 1516, and defined as follows: "−" = production less than 0.9-fold that of the reference; "+" = production at least 0.9-fold that of the reference but less than 1.2-fold reference; "++" = at least 1.2-fold but less than 1.4-fold increased production; and "+++" = at least 1.4-fold increased production.

Shake Flask Powder Characterization Assay and Analysis for Glucosyl Transfer from Sucrose to ADP to Rebaudioside A 60

Shake flask powders (SFP) were reconstituted to a concentration of 4 g/L and diluted to 0.013-0.2 g/L in 100 μL total reaction volume containing 50 mM potassium phosphate buffer, pH 6. Single substrate reactions consisted of 20 g/L rebaudioside A 97% or steviol glycoside 95%, 0.02 g/L ADP, 20 g/L sucrose, and 0.03 g/L SUS SFP SEQ ID NO: 2322. One pot reactions consisted of 100 g/L RebA60, 0.05 g/L ADP, 150 g/L sucrose, 0.2 g/L SUS SFP SEQ ID NO: 2322, and 0.3 g/L β-1,3-glycosyltransferase (β1,3GT) SFP SEQ ID NO: 678. The reactions were performed at 60° C. in a THERMOTRON® titre-plate shaker at 300 RPM for 4 h (single substrate) or 16-18 h (one-pot). One set of SFP dilutions was pre-incubated for 2 h at 75° C. in 50 mM potassium phosphate buffer, pH 6 with 100 g/L rebaudioside A 60%, while another set was not pre-incubated. The reactions were solubilized by diluting to 1 g/L substrate in water, quenched by 5× dilution with acetonitrile with 0.2% formic acid, cleared by centrifugation, and diluted 20× with water for analysis. Glycosylated products were detected by SPE-QQQ as described in Example 5, Table 5.1. To assess thermostability, similar one-pot RebA60 reactions were also performed with 10 μL of crude clarified lysate that had been diluted 70× in 50 mM potassium phosphate buffer, pH 6 with 100 g/L RebA60, and incubated 24 h at 71.8° C. The thermostability results and production levels of rebaudioside D and rebaudioside E in the single substrate and rebaudioside M in the one-pot reactions by these variants at 0.0125 g/L SFP loading are shown in Table 22.2.

TABLE 22.2

β1,2 GT Shake Flask Variants and RebD and RebM Levels

| SEQ ID NO: (nt/aa) | Amino Acid Differences (Relative to SEQ ID NO: 1516) | Increased RebD[a] | Increased RebE[a] | Increased RebM[a] | Increased RebM (pre-incubated)[a] | % Activity Remaining[b] |
|---|---|---|---|---|---|---|
| 1599/1600 | L188E/Q198A/N199Q/Y268A | ++ | ++ | ++ | +++ | ++ |
| 1601/1602 | L188E/H324K | ++ | ++ | ++ | + | + |
| 1603/1604 | L188E/A196V/G201P | ++ | + | ++ | +++ | + |
| 1605/1606 | F152Y/L188E/A196V/Q198A/N199Q/H324K | + | + | ++ | +++ | + |
| 1607/1608 | L188E/A196V/Q198A/N199Q/G201P | + | + | + | +++ | + |
| 1609/1610 | L188E/A196V/Q198F/G201P | + | ++ | ++ | +++ | + |
| 1611/1612 | L188E/G201P | ++ | +++ | ++ | ++ | + |

[a]Levels of increased production were determined relative to the reference polypeptide of SEQ ID NO: 1516, and defined as follows: "+" = production at least that of the reference but less than 1.3-fold reference polypeptide; "++" = production at least 1.3-fold that of the reference but less than 1.6-fold; and "+++" = at least 1.6-fold increased production.
[b]The percent of activity remaining for each variant was determined following 24 h pre-incubation at 71.8° C., relative to the production from each variant following 24 h pre-incubation at 65° C. and is defined as follows: "+" = at least 20% but less than 25% of activity remained following 24 h pre-incubation at 71.8° C.; and "++" = at least 25% activity remained.

In these experiments, all eight variants in Table 22.2 were improved relative to SEQ ID NO: 1516 under both single substrate and both one-pot assays. One variant was also more stable in the 24 h thermostability conditions. This variant, SEQ ID NO: 1516, was further engineered by introducing the beneficial amino acid mutation G96K that was present in several of these shake flask powders (Table 22.3) to produce SEQ ID NO: 1641/1642. This enzyme, SEQ ID NO: 1642 was selected as the best enzyme for the catalysis of glycosyltransfer from ADP-glucose to stevioside and rebaudioside A for the formation of rebaudioside E and rebaudioside D, respectively, and for formation of rebaudioside M in a one-pot reaction with a sucrose synthase and a β-1,3-glycosyltransferase.

Example 23

Sucrose Synthase Variants of SEQ ID NO: 22

Directed evolution of the sucrose synthase encoded by SEQ ID NO:21 was continued by constructing a library of variant genes in which certain structural features of the enzyme were subjected to saturation mutagenesis. This library was then plated, grown, and screened using the high-throughput (HTP) assay described below, to provide another round of 88 engineered SuS variant polypeptides with increased activity toward the generation of ADP-glucose.

HTP Coupled Assay for Glucose Transfer from Sucrose to ADP to Rebaudioside A 60 to Form Rebaudioside M Libraries were screened using the following HTP enzyme-coupled assay. Pelleted E. coli cultures were lysed with 400 μL of Tris-HCl, pH 7.5 with 1 mM magnesium sulfate and 0.5 mg/mL lysozyme and polymyxin B sulfate (PMBS) and cleared by centrifugation. Lysate was diluted 60-120× into potassium phosphate buffer, pH 6.0, with 14.5 g/L RebA60 and pre-incubated for 1-1.5 hour at 75-77° C. Then, 10 μL diluted, pre-incubated SuS lysate, 0.08 g/L β1,2GT SFP SEQ ID NO: 24, and 0.2 g/L β1,3GT SFP SEQ ID NO: 20, were used in 100 μL reaction volume with 20 g/L RebA60, 0.02 g/L ADP (Amresco, ultra pure grade), 30 g/L sucrose (cane sugar), and 7.2 g/L fructose. The following reaction conditions were used: 50 mM potassium phosphate buffer, pH 6, 60° C. in a THERMOTRON® titre-plate shaker with 300 RPM shaking for 16-18 h. The reaction described above was solubilized by diluting 20× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. After analysis, the engineered SuS variant polypeptides that showed improved activity in this one-pot reaction were identified and are listed in Table 23.1. Shake-flask scale cultures were grown for protein characterization as described in Example 1 for variants with the amino acid mutations shown in Table 23.2.

TABLE 23.1

SUS Saturation Mutagenesis Variants and RebM Levels

| SEQ ID NO: (nt/aa) | Amino Acid Differences (Relative to SEQ ID NO: 22) | Increased RebM, 1 h 77° C. preincubated[a] | Increased RebM, 1.5 h 75° C. preincubated[a] |
|---|---|---|---|
| 1643/1644 | H442Y | + | +++ |
| 1645/1646 | V134R | + | +++ |
| 1647/1648 | P52V | + | +++ |
| 1649/1650 | A524R | + | +++ |
| 1651/1652 | S381R | + | +++ |
| 1653/1654 | K41S | + | +++ |
| 1655/1656 | T519V | + | +++ |
| 1657/1658 | P52G | + | +++ |
| 1659/1660 | K724S | + | +++ |
| 1661/1662 | S532Y | + | +++ |
| 1663/1664 | Y434R | + | +++ |
| 1665/1666 | Q136G | + | +++ |
| 1667/1668 | S381K | + | +++ |
| 1669/1670 | R44I | ++ | +++ |
| 1671/1672 | S381Y | + | +++ |
| 1672/1674 | S738K | ++ | +++ |

TABLE 23.1-continued

SUS Saturation Mutagenesis Variants and RebM Levels

| SEQ ID NO: (nt/aa) | Amino Acid Differences (Relative to SEQ ID NO: 22) | Increased RebM, 1 h 77° C. preincubated[a] | Increased RebM, 1.5 h 75° C. preincubated[a] |
|---|---|---|---|
| 1675/1676 | H154A | + | ++ |
| 1677/1678 | V134P | ++ | ++ |
| 1679/1680 | K41Q | + | ++ |
| 1681/1682 | A97T | ++ | ++ |
| 1683/1684 | S635R | + | ++ |
| 1685/1686 | K724A | + | ++ |
| 1687/1688 | P52Q | ++ | ++ |
| 1689/1690 | S381T | + | ++ |
| 1691/1692 | A59M | + | ++ |
| 1693/1694 | R44L | ++ | ++ |
| 1695/1696 | T42D | ++ | ++ |
| 1697/1698 | E358Q | + | ++ |
| 1699/1700 | P52S | ++ | ++ |
| 1701/1702 | R44T | + | ++ |
| 1703/1704 | E4T | + | ++ |
| 1705/1706 | P47A | + | ++ |
| 1707/1708 | V85T | + | ++ |
| 1709/1710 | A97S | + | ++ |
| 1711/1712 | V641I | + | ++ |
| 1713/1714 | P52T | + | ++ |
| 1715/1716 | P47R | + | ++ |
| 1717/1718 | H343L | + | ++ |
| 1719/1720 | Y434L | + | ++ |
| 1721/1722 | V270L | + | ++ |
| 1723/1724 | E4Q | + | ++ |
| 1725/1726 | V641L | + | ++ |
| 1727/1728 | A59T | ++ | ++ |
| 1729/1730 | S12K | + | ++ |
| 1731/1732 | E3G/P548R | + | ++ |
| 1733/1734 | R44A | + | + |
| 1735/1736 | R71T | + | + |
| 1737/1738 | E536T | + | + |
| 1739/1740 | E129Q | + | + |
| 1741/1742 | S589Q | + | + |
| 1743/1744 | Q603T | + | + |
| 1745/1746 | R570K | + | + |
| 1747/1748 | N266R | + | + |
| 1749/1750 | W57H | + | + |
| 1751/1752 | V134Q | + | + |
| 1753/1754 | W57Y | + | + |
| 1755/1756 | S532T | + | + |
| 1757/1758 | T519C | + | + |
| 1759/1760 | K139G | + | + |
| 1761/1762 | T42E | ++ | + |
| 1762/1764 | M606A | + | + |
| 1765/1766 | P47G | + | + |
| 1767/1768 | G652Y | + | + |
| 1769/1770 | L81H | + | + |
| 1771/1772 | A122P | + | + |
| 1773/1774 | E358P | ++ | + |
| 1775/1776 | G652R | + | + |
| 1777/1778 | E727H | + | + |
| 1779/1780 | Q7L | + | + |
| 1781/1782 | S635G | + | + |
| 1783/1784 | K388A | + | + |
| 1785/1786 | T42I | + | + |
| 1781/1788 | S738A | + | + |
| 1789/1790 | F215L | ++ | + |
| 1791/1792 | R615T | + | + |
| 1793/1794 | V93I | + | + |
| 1795/1796 | Q7H | + | + |
| 1797/1798 | R71Q | + | + |
| 1799/1800 | S532E | + | + |
| 1801/1802 | G175S | + | + |
| 1803/1804 | L81P | + | + |
| 1805/1806 | A524S | + | + |
| 1807/1808 | K388R | + | + |
| 1809/1810 | P47T | + | + |
| 1811/1812 | K388S | + | + |
| 1812/1814 | L81Q | + | + |
| 1815/1816 | Q603M | + | + |
| 1817/1818 | M606P | + | + |

[a]Levels of increased production were determined relative to the reference polypeptide of SEQ ID NO: 22, and defined as follows: "+" = production at least that of the reference but less than 1.3-fold reference polypeptide; "++" = at least 1.3-fold increased production but less than 1.5-fold increased production; and "+++" = at least 1.5-fold increased production relative to the reference polypeptide.

Shake Flask Powder Characterization Assay and Analysis for Glucosyl Transfer from Sucrose to Rebaudioside A 60 to Form Rebaudioside M An experiment was performed to characterize the activity of these engineered SUS variants on sucrose and ADP to facilitate the formation of rebaudioside M from rebaudioside A 60%. Shake flask powder (SFP) was made up to 0.016-0.5 g/L in 14.5 g/L RebA60 in potassium phosphate buffer, pH 6, and an aliquot was pre-incubated at 75° C. for 1.5 hour. 10 µL diluted, either pre-incubated or not pre-incubated SuS lysate, 0.08 g/L β1,2 GT SFP SEQ ID NO: 24, and 0.2 g/L β1,3GT SFP SEQ ID NO: 20, were used in 100 µL reaction volume with 20 g/L RebA60, 0.02 g/L ADP (Amresco, ultra pure grade), 30 g/L sucrose (cane sugar), and 7.2 g/L fructose. The following reaction conditions were used: 50 mM potassium phosphate buffer, pH 6, 60° C. in a THERMOTRON® titre-plate shaker with 300 RPM shaking for 16-18 h. The reaction described above was solubilized by diluting 20× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. To assess thermostability, reactions were also performed with 10 µL of crude clarified lysate that had been diluted 20× in 50 mM potassium phosphate buffer, pH 6, and incubated 20 h at 73.5° C. in 100 µL reaction volume with 15 mM rebaudioside A substrate, 0.02 mM ADP (Amresco, ultra pure grade) cofactor, 37.5 mM sucrose co-substrate, 9 mM fructose, and 0.5 g/L β1,2 GT SFP SEQ ID NO: 24. These single substrate reactions were incubated 4 h at 60° C. and then solubilized by diluting 40× in water, quenched by diluting 5× in acetonitrile with 0.2% formic acid and precipitating by centrifugation, and then the supernatant was diluted 7.5× in water and analyzed as described above. The thermostability results and production levels of rebaudioside M in the one-pot reactions by these variants at 0.006 g/L SFP loading are shown in Table 23.2.

TABLE 23.2

SUS SFP Variants and RebM Levels

| SEQ ID NO: (nt/aa) | Amino Acid Differences (Relative to SEQ ID NO: 22) | Increased RebM[a] | Increased RebM (pre-incubated)[a] | % Activity Remaining[b] |
|---|---|---|---|---|
| 1651/1562 | S381R | ++ | ++ | + |
| 1643/1644 | H442Y | + | ++ | +++ |
| 1649/1670 | A524R | + | + | + |

TABLE 23.2-continued

SUS SFP Variants and RebM Levels

| SEQ ID NO: (nt/aa) | Amino Acid Differences (Relative to SEQ ID NO: 22) | Increased RebM[a] | Increased RebM (pre-incubated)[a] | % Activity Remaining[b] |
|---|---|---|---|---|
| 1645/1646 | V134R | − | + | ++ |
| 1655/1656 | T519V | + | + | + |
| 1659/1660 | K724S | + | ++ | + |
| 1647/1648 | P52V | ++ | + | + |
| 1653/1654 | K41S | + | + | + |

[a]Levels of increased production were determined relative to the reference polypeptide of SEQ ID NO: 22, and defined as follows: "−" = production less than 0.9-fold that of the reference polypeptide; "+" = production at least 0.9-fold that of the reference but less than 1.1-fold reference polypeptide; and "++" = production at least 1.1-fold increased relative to that of the reference polypeptide.
[b]The percent of activity remaining for each variant was determined following 20 h pre-incubation at 73.5° C., relative to the production from each variant following 20 h pre-incubation at 60° C. and is defined as follows: "+" = at least 13% but less than 20% of activity remained following 24 h pre-incubation at 73.5° C.; "++" = at least 20% but less than 30% activity remained; and "++" = at least 30% activity remained.

All 8 of the variants listed in Table 23.2 performed similarly or better than SEQ ID NO: 22, in all three assays. SEQ ID NO: 1652 was selected as the starting point for further enzyme engineering.

Example 24

Sucrose Synthase Variants of SEQ ID NO: 1652

Directed evolution of the sucrose synthase encoded by SEQ ID NO: 1651 was continued by constructing libraries of variant genes in which certain structural features of the enzyme were subjected to saturation mutagenesis and libraries in which mutations associated with improved production identified during the development of the present invention were recombined. These libraries were then plated, grown, and screened using the high-throughput (HTP) assay described below, to provide another round of 111 engineered SuS variant polypeptides with increased activity toward the generation of ADP-glucose.

HTP Coupled Assay for Glucose Transfer from Sucrose to ADP to Rebaudioside A 60 to Form Rebaudioside M Libraries were screened using the following HTP enzyme-coupled assay. Pelleted E. coli cultures were lysed with 400 μL of Tris-HCl, pH 7.5 with 1 mM magnesium sulfate and 0.5 mg/mL lysozyme and polymyxin B sulfate (PMBS) and cleared by centrifugation. Lysate was diluted 120× into potassium phosphate buffer, pH 6.0 with 14.5 g/L RebA60, or 20× (for the combinatorial libraries) or 60× (for the saturation mutagenesis library) into the same buffer with 40 g/L RebA60 and pre-incubated for 2 hours at 75° C. Then, 10 μL diluted, pre-incubated SuS lysate, 0.08 g/L β1,2GT SFP SEQ ID NO: 858, and 0.14 g/L β1,3GT SFP SEQ ID NO: 174, were used in 100 μL reaction volume with 20 g/L RebA60, 0.02 g/L ADP (Amresco, ultra pure grade), 30 g/L sucrose (cane sugar), and 7.2 g/L fructose. The following reaction conditions were used: 50 mM potassium phosphate buffer, pH 6, 60° C. in a THERMOTRON® titre-plate shaker with 300 RPM shaking for 16-18 h. The saturation mutagenesis library was also assayed on the single substrate rebaudioside A 97% at 20 g/L with 0.02 g/L ADP, 30 g/L sucrose, 7.2 g/L fructose, and 0.12 g/L β1,2 GT SFP SEQ ID NO: 994, using lysate that had been diluted 200× in potassium phosphate buffer, pH 6.0 with 40 g/L RebA60 and pre-incubated 2 h at 75° C. The reaction described above was solubilized by diluting 20× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. The resulting engineered sucrose synthase variants that showed improved activity in the one-pot reaction are listed in Table 24.1 and 24.2. Shake-flask scale cultures were grown, lysed, and lyophilized to powder as described in Example 1 for variants listed in Table 24.3.

TABLE 24.1

SUS Combinatorial Variants and RebM Levels

| SEQ ID NO: (nt/aa) | Amino Acid Differences (Relative to SEQ ID NO: 1652) | Increased RebM, 14.5 g/L RebA60 preincubated[a] | Increased RebM, 40 g/L RebA60 preincubated[a] |
|---|---|---|---|
| 1819/1820 | R44I/P52V/A97T/Y434G/H442Y/K724S | +++ | ++ |
| 1821/1822 | Y434G/H442Y | +++ | ++ |
| 1823/1824 | A25T/R44I/P52G/V134R/Y434G/K724S | +++ | + |
| 1825/1826 | A97T/H442Y | +++ | ++ |
| 1827/1828 | K41S/P52V/H442Y | +++ | ++ |
| 1829/1830 | Q136G/H442Y/K724S | +++ | +++ |
| 1831/1832 | R44I/Q136G/E329Q/Y434G/S532Y | +++ | + |
| 1833/1834 | V134R/Q136G/Y434G/S532Y/K724S | +++ | + |
| 1835/1836 | P52G/A97T/H442Y | +++ | +++ |
| 1837/1838 | K41S/P52V/Y434G/H442Y/K724S | +++ | +++ |
| 1839/1840 | R44I/P52V/V134R/Y434G/S532Y | +++ | +++ |
| 1841/1842 | P52V/Q136G/Y434G/K724S | +++ | ++ |
| 1843/1844 | P52V/H442Y/V553A/K724S | +++ | + |
| 1845/1846 | P52V/H442Y | +++ | + |
| 1847/1848 | K41S/P52V/Y434G | ++ | + |
| 1849/1850 | P52V/Q136G/Y434G/H442Y | ++ | + |
| 1851/1852 | P52V/Q136G/Y434G | ++ | + |
| 1853/1854 | K41S/Y434G/H442Y/S532Y | ++ | +++ |
| 1855/1856 | P52V/Y434G | ++ | + |
| 1857/1858 | H442Y | ++ | + |
| 1859/1860 | P52V/Q136G/H442Y | ++ | + |
| 1861/1862 | R44I/Y434G/H442Y/V553A | ++ | + |
| 1863/1864 | K41S/R44I/P52G/A97T/H442Y/A719T/K724S | ++ | + |
| 1865/1866 | K41S/P52V/V134R/Q136G/Y434G | ++ | ++ |
| 1867/1868 | R44I/P52V/A97T/H442Y/K724S | ++ | + |

TABLE 24.1-continued

SUS Combinatorial Variants and RebM Levels

| SEQ ID NO: (nt/aa) | Amino Acid Differences (Relative to SEQ ID NO: 1652) | Increased RebM, 14.5 g/L RebA60 preincubated[a] | Increased RebM, 40 g/L RebA60 preincubated[a] |
|---|---|---|---|
| 1869/1870 | P52G/A97T/Y434G/H442Y | ++ | ++ |
| 1817/1872 | P52G/Y434G/H442Y/S532Y | ++ | +++ |
| 1873/1874 | K41S/R44I/P52G/Y434G/K724S | ++ | + |
| 1875/1876 | K41S/Y434G/S532Y | ++ | + |
| 1877/1878 | K41S/Y434G/H442Y/S532Y/K724S | ++ | ++ |
| 1879/1880 | P52G/V134R | ++ | + |
| 1881/1882 | V134R/Y434G/H442Y/K724S | ++ | + |
| 1883/1884 | P52G/A97T | ++ | + |
| 1885/1886 | P52G/V134R/E329Q/Y434G | ++ | + |
| 1887/1888 | P52G/H442Y/K724S | ++ | ++ |
| 1889/1890 | K41S/R44I/Q136G/H442Y | ++ | + |
| 1891/1892 | P52G/V134R/Q136G/H442Y | ++ | +++ |
| 1893/1894 | A97T/V134R/H442Y | ++ | ++ |
| 1895/1896 | K41S/S532Y | + | + |
| 1897/1898 | K41S/P52V/A97T/Y434G/H442Y/S532Y/K724S | + | ++ |
| 1899/1900 | Q136G/S532Y/K724S | + | + |
| 1901/1902 | P52V/Q136G/Y434G/H442Y/S532Y | + | + |
| 1903/1904 | K41S/E329Q/H442Y | + | + |
| 1905/1906 | V134R/Q136G/Y434G/H442Y/V553A/K724S | + | ++ |
| 1907/1908 | A97T/Q136G/Y434G/H442Y | + | +++ |
| 1909/1910 | R44I/Q136G/S532Y | + | + |
| 1911/1912 | P52G/H442Y/V553A/K724S | + | + |
| 1913/1914 | V134R/Q136G/Y434G/H442Y/S532Y/V553A/K724S | + | + |
| 1915/1916 | K41S/R44I/P52V/V134R/H442Y | + | ++ |
| 1917/1918 | K41S/P52V/Y434G/H442Y | + | + |
| 1919/1920 | P52V/S532Y | + | + |
| 1921/1922 | V134R | + | + |
| 1923/1924 | K41S/R44I/Q136G/E329Q | + | + |
| 1925/1926 | K41S/R44I/S532Y | + | ++ |
| 1927/1928 | Y434G | + | + |
| 1929/1930 | K41S/P52G/Q136G | + | ++ |
| 1931/1932 | K41S/A97T/V134R/Y434G/H442Y/S532Y/V553A | + | +++ |
| 1933/1934 | P52G/V134R/Y434G/H442Y/S532Y/V553A | + | ++ |
| 1935/1936 | P52V/H442Y/K724S | + | + |
| 1937/1938 | Q136G/H442Y | + | ++ |
| 1939/1940 | H442Y/K724S | + | + |
| 1941/1942 | P52G/Q136G | + | ++ |
| 1943/1944 | P52G/V134R/Q136G/Y434G | + | + |
| 1945/1946 | V134R/Q136G/Y434G/H442Y | + | + |
| 1947/1948 | P52G | + | + |
| 1949/1950 | P52G/H442Y | + | +++ |
| 1951/1952 | A97T/E329Q/K724S | + | + |
| 1953/1954 | P52V/Y434G/S532Y | + | + |
| 1955/1956 | K41S/V134R/H442Y/S532Y | + | ++ |
| 1957/1958 | K41S/R44I/P52G/Y434G/H442Y/S532Y/K724S | + | + |
| 1959/1960 | A97T/V134R/Q136G/H442Y/S532Y | + | ++ |
| 1961/1962 | P52G/A97T/S532Y | + | + |
| 1963/1964 | P52G/S532Y | + | + |
| 1965/1966 | P52G/V553A | + | + |
| 1967/1968 | P52V/Y434G/H442Y/K724S | + | + |
| 1969/1970 | Q136G | + | ++ |
| 1971/1972 | R44I/P52G/V134R/Q136G/E329Q/Y434G/H442Y/S532Y | + | + |
| 1973/1974 | V134R/Q136G/H442Y/S532Y | + | ++ |
| 1975/1976 | A97T/V134R/Q136G/S532Y | + | + |
| 1977/1978 | W57C/A97T/Y434G/H442Y/K724S | + | + |
| 1979/1980 | P52V/V134R/H442Y/K724S | + | + |
| 1981/1982 | P52V/V134R/E329Q/S532Y | + | + |
| 1983/1984 | P52V/H442Y/S532Y/K724S | + | + |
| 1985/1986 | S532Y/K724S | + | + |
| 1987/1988 | K41S/P52G/V134R/H442Y/K724S | + | ++ |

[a]Levels of increased production were determined relative to the reference polypeptide of SEQ ID NO: 1652, and defined as follows: "+" = production at least that of the reference but less than 1.15-fold reference polypeptide; "++" = at least 1.15-fold increased production but less than 1.3-fold increased production; and "+++" = at least 1.3-fold increased production relative to the reference polypeptide.

TABLE 24.2

SUS Saturation Mutagenesis Variants and RebM Levels

| SEQ ID NO: (nt/aa) | Amino Acid Differences (Relative to SEQ ID NO: 1652) | Increased RebM[a] | Increased RebD[a] |
|---|---|---|---|
| 1989/1990 | R38V | +++ | +++ |
| 1991/1992 | R38L | ++ | + |
| 1993/1994 | Y51H/L433P | ++ | ++ |
| 1995/1996 | R38N | ++ | + |
| 1997/1998 | E4V | ++ | +++ |
| 1999/2000 | H22T | + | + |
| 2001/2002 | Y51A | + | ++ |
| 2003/2004 | P47S/D488N | + | +++ |
| 2005/2006 | T708V | + | + |
| 2007/2008 | T34E | + | ++ |
| 2009/2010 | V62I | + | ++ |
| 2011/2012 | M75I/Q169A | + | + |
| 2013/2014 | L101V | + | + |
| 2015/2016 | R38W | + | + |
| 2017/2018 | H22L | + | + |
| 2019/2020 | S195K/A213T | + | + |
| 2021/2022 | L32S | + | – |
| 2023/2024 | Q169E | + | ++ |
| 2025/2026 | E3A | + | – |
| 2027/2028 | Y51T | + | ++ |
| 2029/2030 | A718H | + | – |
| 2031/2032 | Y51H | + | ++ |
| 2033/2034 | T34S | + | +++ |

[a]Levels of increased production were determined relative to the reference polypeptide of SEQ ID NO: 1652, and defined as follows: "–" = production less than 0.9-fold that of reference polypeptide; "+" = production at least 0.9-fold that of the reference but less than 1.1-fold reference polypeptide; "++" = at least 1.1-fold increased production but less than 1.2-fold increased production; and "+++" = at least 1.2-fold increased production relative to the reference polypeptide.

Shake Flask Powder Characterization Assay and Analysis for Glucosyl Transfer from Sucrose to Rebaudioside A 60 to Form Rebaudioside M An experiment was performed to characterize the activity of these engineered SUS variants on sucrose and ADP to facilitate the formation of rebaudioside M from rebaudioside A 60%. Shake flask powder (SFP) was made up to 0.016-0.5 g/L in potassium phosphate buffer, pH 6 with and without 40 g/L RebA60, and the solutions with RebA60 were pre-incubated at 75° C. for 2 hours. 10 μL diluted, either pre-incubated or not pre-incubated SuS lysate, 0.08 g/L β1,2 GT SFP SEQ ID NO: 858, and 0.14 g/L β1,3GT SFP SEQ ID NO: 174, were used in 100 μL reaction volume with 20 g/L RebA60, 0.02 g/L ADP (Amresco, ultra pure grade), 30 g/L sucrose (cane sugar), and 7.2 g/L fructose. The following reaction conditions were used: 50 mM potassium phosphate buffer, pH 6, 60° C. in a THERMOTRON® titre-plate shaker with 300 RPM shaking for 16-18 h. The reaction described above was solubilized by diluting 20× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. To assess thermostability, reactions were also performed with 10 μL of crude clarified lysate that had been diluted 20× in 50 mM potassium phosphate buffer, pH 6 with 40 g/L RebA60, and incubated 24 h at 71.1° C. in 100 μL reaction volume under the same one-pot reaction conditions described above. The thermostability results and production levels of rebaudioside M in the one-pot reactions by these variants at 0.0125 g/L SFP loading are shown in Table 24.3.

TABLE 24.3

SUS SFP Variants and RebM Levels

| SEQ ID NO: (nt/aa) | Amino Acid Differences (Relative to SEQ ID NO: 1652) | Increased RebM[a] | Increased RebM (pre-incubated)[a] | % Activity Remaining[b] |
|---|---|---|---|---|
| 1835/1836 | P52G/A97T/H442Y | + | + | ++ |
| 1867/1868 | R44I/P52V/A97T/H442Y/K724S | + | + | +++ |
| 1825/1826 | A97T/H442Y | + | + | ++ |
| 1821/1822 | Y434G/H442Y | + | + | ++ |

[a]Levels of increased production were determined relative to the reference polypeptide of SEQ ID NO: 1652, and defined as follows: "–" = production less than 0.9-fold that of the reference polypeptide; and "+" = production at least 0.9-fold that of the reference but less than 1.1-fold reference polypeptide.
[b]The percent of activity remaining for each variant was determined following 24 h pre-incubation at 71.1° C., relative to the production from each variant following 24 h pre-incubation at 65° C. and is defined as follows: "+" = at least 15% but less than 20% of activity remained following 24 h pre-incubation at 71.1° C.; and "++" = at least 20% activity remained.

The four variants listed in Table 24.3 performed similarly to SEQ ID NO: 1652 in both activity assays and were more thermostable in the 24 h pre-incubation assay. One variant, SEQ ID NO: 1822 exhibited slightly higher activity in the one-pot assays, and it was selected as the starting point for further enzyme engineering.

Example 25

Sucrose Synthase Variants of SEQ ID NO: 1822

Directed evolution of the sucrose synthase encoded by SEQ ID NO: 1821 was continued by constructing libraries of variant genes in which certain structural features of the enzyme were subjected to saturation mutagenesis and libraries in which mutations associated with improved production identified during the development of the present invention were recombined. These libraries were then plated, grown, and screened using the high-throughput (HTP) assay described below, to provide an additional round of 63 engineered SuS variant polypeptides with increased activity toward the generation of ADP-glucose.

HTP Coupled Assay for Glucose Transfer from Sucrose to ADP to Rebaudioside A 60 to Form Rebaudioside M Libraries were screened using the following HTP enzyme-coupled assay. Pelleted *E. coli* cultures were lysed with 400 μL of Tris-HCl, pH 7.5 with 1 mM magnesium sulfate and 0.5 mg/mL lysozyme and polymyxin B sulfate (PMBS) and cleared by centrifugation. Lysate was diluted 90× into potassium phosphate buffer, pH 6.0 with 40 g/L RebA60 and pre-incubated for 2 hours at 75° C. Saturation mutagenesis samples were retested with this pre-incubation condition and with 80 g/L RebA60 pre-incubation. Then, 10 μL diluted, pre-incubated SuS lysate, 0.04 g/L β1,2GT SFP SEQ ID NO: 994, and 0.08 g/L β1,3GT SFP SEQ ID NO: 350, were used in 100 μL reaction volume with 20 g/L RebA60, 0.02 g/L ADP (Amresco, ultra pure grade), 30 g/L sucrose (cane sugar), and 7.2 g/L fructose. The following reaction conditions were used: 50 mM potassium phosphate buffer, pH 6, 60° C. in a THERMOTRON® titre-plate shaker with 300 RPM shaking for 16-18 h. The reactions described above were solubilized by diluting 20× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. The resulting engineered sucrose synthase variants that showed improved activity in the one-pot reaction are listed in Table 25.1 and 25.2. Shake-flask scale cultures were grown, lysed, and lyophilized to powder as described in Example 1 for variants listed in Table 25.3.

TABLE 25.1

SUS Combinatorial Variants and RebM Levels

| SEQ ID NO: (nt/aa) | Amino Acid Differences (Relative to SEQ ID NO: 1822) | Increased RebM[a] |
|---|---|---|
| 2035/2036 | V62I/T708V | +++ |
| 2037/2038 | Q169A/T708V | +++ |
| 2039/2040 | E4V/T708V | +++ |
| 2041/2042 | E4V/L433P | +++ |
| 2043/2044 | H22L/T34S/Q169A/T708V | +++ |
| 2045/2046 | E4V/H22L/Y51A/T708V | ++ |
| 2047/2048 | H22T/T34E/L101V/Q169E | ++ |
| 2049/2050 | T34S/R38L/V62I | ++ |
| 2051/2052 | E4V/H22T/T34E/R38N | ++ |
| 2053/2054 | E4V/H22L/L101V | ++ |
| 2055/2056 | E4V/H22L/T34E | ++ |
| 2057/2058 | E4V/T34E/T708V | ++ |
| 2059/2060 | E4V/Q169A | ++ |
| 2061/2062 | E4V/V62I/L433P/T708V | ++ |
| 2063/2064 | H22T/T34E/L101V/Q169E/S195K | + |
| 2065/2066 | H22T/P47S/Q169A/L433P | + |
| 2067/2068 | E4V/H22T | + |
| 2069/2070 | M75I/Q169A | + |
| 2071/2072 | T34E/L101V | + |
| 2073/2074 | E4V/H22T/T34E/R38V/Q169A/T708V | + |
| 2075/2076 | H22L/M75I | + |
| 2077/2078 | E4V/Q169A/T708V | + |
| 2079/2080 | E4V/T34E/R38N/L101V | + |
| 2081/2082 | T34E/V62I/Q169E/L433P | + |
| 2083/2084 | S195K/T708V | + |
| 2085/2086 | E4V/H22T/T34E/P47S/Y51H/Q169A/A213T | + |
| 2087/2088 | H22L/T34E | + |
| 2089/2090 | H22T/T34E/R38V | + |
| 2091/2092 | E4V/Q169A/L433P | + |

[a]Levels of increased production were determined relative to the reference polypeptide of SEQ ID NO: 1822, and defined as follows: "+" = production at least that of the reference but less than 1.19-fold reference polypeptide; "++" = at least 1.19-fold increased production but less than 1.22-fold increased production; and "+++" = at least 1.22-fold increased production relative to the reference polypeptide.

TABLE 25.2

SUS Saturation Mutagenesis Variants and RebM Levels

| SEQ ID NO: (nt/aa) | Amino Acid Differences (Relative to SEQ ID NO: 1822) | Increased RebM, 40 g/L RebA60 preincubated[a] | Increased RebM, 80 g/L RebA60 preincubated[a] |
|---|---|---|---|
| 2093/2094 | V602P | + | +++ |
| 2095/2096 | S585A | ++ | +++ |
| 2097/2098 | M565V | + | +++ |
| 2099/2100 | H623K | + | +++ |
| 2101/2102 | R518S | + | +++ |
| 2147/2148 | L433P | + | +++ |
| 2149/2150 | Q169A | + | ++ |
| 2151/2152 | E4V | ++ | ++ |
| 2103/2104 | R557P | + | ++ |
| 2105/2106 | D731Q | + | ++ |
| 2107/2108 | D441A | + | ++ |
| 2109/2110 | D731T | + | ++ |
| 2111/2112 | E121D | + | ++ |
| 2113/2114 | D441L | ++ | ++ |
| 2115/2116 | T526H | + | ++ |
| 2153/2154 | T708V | + | ++ |
| 2117/2778 | E528Q | − | ++ |
| 2119/2120 | N604A | + | ++ |
| 2155/2156 | H22L | − | ++ |
| 2157/2158 | T34E | + | + |
| 2121/2122 | D731M | + | + |
| 2159/2160 | H22T | + | + |
| 2123/2124 | D731A | + | + |
| 2125/2126 | Q558G | + | + |
| 2127/2128 | V770T | + | + |
| 2129/2130 | P341N | − | + |
| 2131/2132 | H623Q | + | + |
| 2133/2134 | T526V | + | + |
| 2135/2136 | E527Q | − | + |
| 2137/2138 | L411I | + | + |
| 2139/2140 | H623A | − | + |
| 2141/2142 | E527A | − | + |
| 2143/2144 | R544H | + | + |
| 2145/2146 | H623R | ++ | + |

[a]Levels of increased production were determined relative to the reference polypeptide of SEQ ID NO: 1822, and defined as follows: "−" = production less than 0.9-fold that of the reference; "+" = production at least 0.9-fold that of the reference but less than 1.1-fold reference polypeptide; "++" = at least 1.1-fold increased production but less than 1.2-fold increased production; and "+++" = at least 1.2-fold increased production relative to the reference polypeptide.

Shake Flask Powder Characterization Assay and Analysis for Glucosyl Transfer from Sucrose to Rebaudioside A 60 to Form Rebaudioside M An experiment was performed to characterize the activity of some of these engineered SUS variants on sucrose and ADP to facilitate the formation of rebaudioside M from rebaudioside A 60%. Shake flask powder (SFP) was made up to 0.016-0.5 g/L in potassium phosphate buffer, pH 6 with and without 80 g/L RebA60, and the solutions with RebA60 were pre-incubated at 75° C. for 2 hours. 10 µL diluted, either pre-incubated or not pre-incubated SuS lysate, 0.04 g/L β1,2 GT SFP SEQ ID NO: 994, and 0.08 g/L β1,3GT SFP SEQ ID NO: 350 were used in 100 µL reaction volume with 20 g/L RebA60, 0.02 g/L ADP (Amresco, ultra pure grade), 30 g/L sucrose (cane sugar), and 7.2 g/L fructose. The following reaction conditions were used: 50 mM potassium phosphate buffer, pH 6, 60° C. in a THERMOTRON® titre-plate shaker with 300 RPM shaking for 16-18 h. The reaction described above was solubilized by diluting 20× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. To assess thermostability, reactions were also performed with 10 µL of crude clarified lysate that had been diluted 200× in 50 mM potassium phosphate buffer, pH 6 with 40 g/L RebA60, and incubated 24 h at 71.1° C. in 100 µL reaction volume under the same one-pot reaction conditions described above. The thermostability results and production levels of rebaudioside M in the one-pot reactions by these variants at 0.0125 g/L SFP loading are shown in Table 25.3.

TABLE 25.3

SUS SFP Variants and RebM Levels

| SEQ ID NO: (nt/aa) | Amino Acid Differences (Relative to SEQ ID NO: 1822) | Increased RebM[a] | Increased RebM (pre-incubated)[a] | % Activity Remaining[b] |
|---|---|---|---|---|
| 2151/2152 | E4V | + | ++ | ++ |
| 2035/2036 | V62I/T708V | + | + | ++ |
| 2051/2052 | E4V/H22T/T34E/R38N | + | + | + |
| 2091/2092 | E4V/Q169A/L433P | + | +++ | ++ |
| 2041/2042 | E4V/L433P | + | +++ | ++ |

TABLE 25.3-continued

SUS SFP Variants and RebM Levels

| SEQ ID NO: (nt/aa) | Amino Acid Differences (Relative to SEQ ID NO: 1822) | Increased RebM[a] | Increased RebM (pre-incubated)[a] | % Activity Remaining[b] |
|---|---|---|---|---|
| 2037/2038 | Q169A/T708V | + | + | + |
| 2059/2060 | E4V/Q169A | ++ | + | ++ |

[a] Levels of increased production were determined relative to the reference polypeptide of SEQ ID NO: 1822, and defined as follows: "+" = production at least that of the reference but less than 1.1-fold reference polypeptide; "++" = production at least 1.1-fold but less than 1.25-fold; and "+++" = production at least 1.25-fold increased relative to that of the reference polypeptide.
[b] The percent of activity remaining for each variant was determined following 24 h pre-incubation at 71.1° C., relative to the production from each variant following 24 h pre-incubation at 65° C. and is defined as follows: "+" = at least 25% but less than 30% of activity remained following 24 h pre-incubation at 71.1° C.; and "++" = at least 30% activity remained.

All 7 variants listed in Table 25.3 performed similarly or better than SEQ ID NO: 1822 in both activity assays and in the 24 h pre-incubation assay. The most active variant following 2 h pre-incubation at 75° C. in 80 g/L rebaudioside A 60%, SEQ ID NO: 2092, was selected as the starting point for further enzyme engineering.

Example 26

Sucrose Synthase Variants of SEQ ID NO: 2092

Directed evolution of the sucrose synthase encoded by SEQ ID NO: 2092 was continued by constructing libraries of variant genes in which certain structural features of the enzyme were subjected to saturation mutagenesis and libraries in which mutations associated with improved production identified during the development of the present invention were recombined. These libraries were then plated, grown, and screened using the high-throughput (HTP) assay described below, to provide another round of 74 engineered SuS variant polypeptides with increased activity toward the generation of ADP-glucose.

HTP Coupled Assay for Glucose Transfer from Sucrose to ADP to Rebaudioside A 60 to Form Rebaudioside M Libraries were screened using the following HTP enzyme-coupled assay. Pelleted *E. coli* cultures were lysed with 400 μL of Tris-HCl, pH 7.5 with 1 mM magnesium sulfate and 0.5 mg/mL lysozyme and polymyxin B sulfate (PMBS) and cleared by centrifugation. Lysate was diluted 50-100× into potassium phosphate buffer, pH 6.0 with 100 g/L RebA60 and pre-incubated for 2 hours at 75° C. Then, 10 μL diluted, pre-incubated SuS lysate, 0.04 g/L β1,2GT SFP SEQ ID NO: 1080, and 0.2 g/L β1,3GT SFP SEQ ID NO: 440, were used in 100 μL reaction volume with 30 g/L RebA60, 0.02 g/L ADP (Amresco, ultra pure grade), 30 g/L sucrose (cane sugar), and 7.2 g/L fructose. The saturation mutagenesis library was also retested with 10 μL diluted, pre-incubated SuS lysate, 0.2 g/L β1,2 GT SFP SEQ ID NO: 1080, and 0.43 g/L β1,3GT SFP SEQ ID NO: 440 in 100 μL reaction volume with 50 g/L RebA60, 0.01 g/L ADP (Amresco, ultra pure grade), 75 g/L sucrose (cane sugar), and 18 g/L fructose. The following reaction conditions were used: 50 mM potassium phosphate buffer, pH 6, 60° C. in a THERMOTRON® titre-plate shaker with 300 RPM shaking for 16-18 h. The reactions described above were solubilized by diluting to 1-1.5 g/L starting RebA60 in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. The resulting engineered sucrose synthase variants that showed improved activity in the one-pot reaction are listed in Table 26.1 and 26.2. Shake-flask scale cultures were grown, lysed, and lyophilized to powder as described in Example 1 for variants listed in Table 26.3.

TABLE 26.1

SUS Combinatorial Variants and RebM Levels

| SEQ ID NO: (nt/aa) | Amino Acid Differences (Relative to SEQ ID NO: 2092) | Increased RebM[a] |
|---|---|---|
| 2161/2162 | T34E/V62I/D441L/R557P/H623K | +++ |
| 2163/2164 | T34E/D441L/S585A/H623K/T708V/D731Q | +++ |
| 2165/2166 | D441L/S585A/V602P/N604A/H623R/T708V/D731Q | +++ |
| 2167/2168 | D441L/R518S/R557P/M565V/S585A | +++ |
| 2169/2170 | D441L/R518S/T526H/R557P/M565V/V602P/N604A/H623K/T708V | +++ |
| 2171/2172 | L411I/D441L/R518S/R557P/H623K | +++ |
| 2173/2174 | T34E/V62I/H623K/D731Q | +++ |
| 2175/2176 | T34E/V62I/L411I/R557P/V602P/N604A | +++ |
| 2177/2178 | V62I/E121D/D441L/M565V/S585A | +++ |
| 2179/2180 | T34E/V62I/R518S/H623K | +++ |
| 2181/2182 | D441L/R518S/T526H/R557P/S585A/N604A/H623R/T708V | +++ |
| 2183/2184 | L411I/D441L/N604A/H623K/T708V/D731Q | ++ |
| 2185/2186 | T34E/D441L/R518S/T526H/S585A/N604A/D731Q | ++ |
| 2187/2188 | V62I/D441L/H623R/T708V/V770T | ++ |
| 2189/2190 | E121D/N604A/T708V/D731Q/V770T | ++ |
| 2191/2192 | T34E/D441L/T526H/M565V/T708V/V770T | ++ |
| 2192/2194 | D441L/R518S/T526H/N604A/H623R | ++ |
| 2195/2196 | V62I/L411I/T526H/M565V/N604A/H623K | ++ |
| 2197/2198 | R557P/N604A | ++ |
| 2199/2200 | E121D/D441L/R518S/T526H/V602P/N604A | ++ |
| 2201/2202 | L411I/R518S/T526H/N604A/H623K/D731Q | ++ |
| 2203/2204 | T34E/D441L/R544H/R557P/S585A/V602P/H623K | ++ |
| 2205/2206 | L411I/S585A/H623K | ++ |
| 2207/2208 | V62I/E121D/L411I/D441L/R518S/R544H/R557P/S585A/N604A/H623K | ++ |
| 2209/2210 | V62I/E121D/D441L/R518S/T526H/H623R/V770T | ++ |
| 2211/2212 | V62I/L411I/S585A/D731Q | ++ |
| 2213/2214 | T34E/E121D/T526H/N604A/D731Q | ++ |
| 2215/2216 | L411I/M565V/N604A/H623R | + |
| 2217/2218 | D441L/R518S/M565V/H623R/D731Q/V770T | + |

TABLE 26.1-continued

SUS Combinatorial Variants and RebM Levels

| SEQ ID NO: (nt/aa) | Amino Acid Differences (Relative to SEQ ID NO: 2092) | Increased RebM[a] |
|---|---|---|
| 2219/2220 | T34E/V62I/L411I/T526H/R557P | + |
| 2221/2222 | T34E/L411I/D441L | + |
| 2223/2224 | V62I/E121D/R518S/R557P/S585A/N604A/T708V/V770T | + |
| 2225/2226 | E121D/D441L/R518S/T526H/H623K/T708V | + |
| 2227/2228 | V62I/D441L/R518S/R557P/N604A/H623K/T708V/D731Q | + |
| 2229/2230 | V62I/D441L/V770T | + |
| 2231/2232 | D441L/R518S/S585A | + |
| 2233/2234 | R557P/V602P/N604A | + |
| 2235/2236 | D441L/S585A | + |
| 2237/2238 | T34E/L411I/D441L/R518S/R544H/R557P/M565V/T708V/D731Q | + |
| 2239/2240 | H623R | + |
| 2241/2242 | T34E/L411I/D441L/R518S/S585A/N604A/V770T | + |
| 2243/2244 | T34E/E121D/D441L/R544H/N604A/H623K | + |
| 2245/2246 | V62I/E121D/E329Q/R518S/R557P/M565V/H623R/T708V | + |
| 2247/2248 | E121D/D441L/T526H/R557P/M565V/T708V | + |
| 2249/2250 | D441L/T708V/D731Q | + |
| 2251/2252 | T34E/T526H/S585A/H623K | + |
| 2253/2254 | S585A/H623R/T708V | + |
| 2255/2256 | T34E/L411I/D441L/R518S/T526H/R557P/M565V/D731Q | + |
| 2257/2258 | L411I/D441L/R518S/T708V | + |

[a]Levels of increased production were determined relative to the reference polypeptide of SEQ ID NO: 2092, and defined as follows: "+" = production at least 1.3-fold that of the reference but less than 1.47-fold reference polypeptide; "++" = at least 1.47-fold increased production but less than 1.7-fold increased production; and "+++" = at least 1.7-fold increased production relative to the reference polypeptide.

TABLE 26.2

SUS Saturation Mutagenesis Variants and RebM Levels

| SEQ ID NO: (nt/aa) | Amino Acid Differences (Relative to SEQ ID NO: 2092) | Increased RebM, 30 g/L RebA60 preincubated[a] | Increased RebM, 50 g/L RebA60 preincubated[a] |
|---|---|---|---|
| 2269/2270 | T640A | +++ | +++ |
| 2271/2272 | T640N | ++ | +++ |
| 2273/2274 | T640R | +++ | +++ |
| 2275/2276 | T65C | +++ | ++ |
| 2277/2278 | A63T | − | ++ |
| 2279/2280 | A63G | + | ++ |
| 2281/2282 | T640E | +++ | ++ |
| 2283/2284 | T640H | +++ | ++ |
| 2285/2286 | A323G | +++ | ++ |
| 2287/2288 | N406G | + | + |
| 2289/2290 | T640W | − | + |
| 2291/2292 | L416F | + | + |
| 2293/2294 | V511L | − | + |
| 2295/2296 | A323S | + | + |
| 2297/2298 | I269V | − | + |
| 2299/2300 | A63S | +++ | + |
| 2301/2302 | T640V | − | + |
| 2303/2304 | A323T | ++ | + |
| 2305/2306 | T65L | + | + |
| 2307/2308 | T469S | − | + |

[a]Levels of increased production were determined relative to the reference polypeptide of SEQ ID NO: 2092, and defined as follows: "−" = production less than 0.9-fold that of the reference; "+" = production at least 0.9-fold but less than 1.1-fold that of the reference; "++" = at least 1.1-fold but less than 1.2-fold increased production; and "+++" = at least 1.2-fold increased production relative to the reference polypeptide.

Shake Flask Powder Characterization Assay and Analysis for Glucosyl Transfer from Sucrose to Rebaudioside A 60 to Form Rebaudioside M An experiment was performed to characterize the activity of some of the engineered SUS variants on sucrose and ADP to facilitate the formation of rebaudioside M from rebaudioside A 60%. Shake flask powder (SFP) was made up to 0.016-0.5 g/L in potassium phosphate buffer, pH 6 with and without 100 g/L RebA60, and the solutions with RebA60 were pre-incubated at 75° C. for 2 hours. 10 μL diluted, either pre-incubated or not pre-incubated SuS lysate, 0.04 g/L β1,2 GT SFP SEQ ID NO: 1080, and 0.2 g/L β1,3GT SFP SEQ ID NO: 440 were used in 100 μL reaction volume with 30 g/L RebA60, 0.02 g/L ADP (Amresco, ultra pure grade), 30 g/L sucrose (cane sugar), and 7.2 g/L fructose. The following reaction conditions were used: 50 mM potassium phosphate buffer, pH 6, 60° C. in a THERMOTRON® titre-plate shaker with 300 RPM shaking for 16-18 h. The reaction described above was solubilized by diluting 30× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. To assess thermostability, reactions were also performed with 10 μL of crude clarified lysate that had been diluted 100× in 50 mM potassium phosphate buffer, pH 6 with 100 g/L RebA60, and incubated 24 h at 71.1° C. in 100 μL reaction volume under the same one-pot reaction conditions described above. The thermostability results and production levels of rebaudioside M in the one-pot reactions by these variants at 0.0125 g/L SFP loading are shown in Table 26.3.

TABLE 26.3

SUS SFP Variants and RebM Levels

| SEQ ID NO: (nt/aa) | Amino Acid Differences (Relative to SEQ ID NO: 2092) | Increased RebM[a] | Increased RebM (pre-incubated)[a] | % Activity Remaining[b] |
|---|---|---|---|---|
| 2163/2664 | T34E/D441L/S585A/H623K/T708V/D731Q | + | ++ | + |
| 2167/2168 | D441L/R518S/R557P/M565V/S585A | ++ | ++ | + |

TABLE 26.3-continued

SUS SFP Variants and RebM Levels

| SEQ ID NO: (nt/aa) | Amino Acid Differences (Relative to SEQ ID NO: 2092) | Increased RebM[a] | Increased RebM (pre-incubated)[a] | % Activity Remaining[b] |
|---|---|---|---|---|
| 2161/2162 | T34E/V62I/D441L/R557P/H623K | + | + | + |
| 2165/2166 | D441L/S585A/V602P/N604A/H623R/T708V/D731Q | + | + | + |
| 2171/2172 | L411I/D441L/R518S/R557P/H623K | ++ | + | + |
| 2183/2184 | L411I/D441L/N604A/H623K/T708V/D731Q | ++ | ++ | ++ |
| 2181/2182 | D441L/R518S/T526H/R557P/S585A/N604A/H623R/T708V | + | ++ | +++ |
| 2187/2188 | V62I/D441L/H623R/T708V/V770T | ++ | + | + |

[a]Levels of increased production were determined relative to the reference polypeptide of SEQ ID NO: 2092, and defined as follows: "−" = production less than 0.9-fold that of the reference polypeptide; "+" = production at least 0.9-fold that of the reference but less than 1.1-fold reference polypeptide; and "++" = production at least 1.1-fold increased relative to that of the reference polypeptide.
[b]The percent of activity remaining for each variant was determined following 24 h pre-incubation at 71.1° C., relative to the production from each variant following 24 h pre-incubation at 65° C. and is defined as follows: "+" = at least 14% but less than 18% of activity remained following 24 h pre-incubation at 71.1° C.; "++" = at least 18% but less than 30% activity remained; and "+++" = at least 30% activity remained.

All 8 variants listed in Table 26.3 performed similarly or better than SEQ ID NO: 2092 in both activity assays and in the 24 h pre-incubation assay. The most thermostable variant following 24 h pre-incubation, SEQ ID NO: 2182, was selected as the starting point for further enzyme engineering.

Example 27

Sucrose Synthase Variants of SEQ ID NO: 2182

Directed evolution of the sucrose synthase encoded by SEQ ID NO: 2182 was continued by constructing libraries of variant genes in which certain structural features of the enzyme were subjected to saturation mutagenesis and libraries in which mutations associated with improved production identified during the development of the present invention were recombined. These libraries were then plated, grown, and screened using the high-throughput (HTP) assay described below, to provide another round of 80 engineered SuS variant polypeptides with increased activity toward the generation of ADP-glucose.
HTP Coupled Assay for Glucose Transfer from Sucrose to ADP to Rebaudioside A 60 to Form Rebaudioside M Libraries were screened using the following HTP enzyme-coupled assay. Pelleted E. coli cultures were lysed with 400 μL of Tris-HCl, pH 7.5 with 1 mM magnesium sulfate and 0.5 mg/mL lysozyme and polymyxin B sulfate (PMBS) and cleared by centrifugation. Lysate was diluted 75-100× into potassium phosphate buffer, pH 6.0 with 100 g/L RebA60 and pre-incubated for 2 hour at 75° C. Then, 10 μL diluted, pre-incubated SuS lysate, 0.2 g/L β1,2GT SFP SEQ ID NO: 1216, and 0.43 g/L β1,3GT SFP SEQ ID NO: 520, were used in 100 μL reaction volume with 50 g/L RebA60, 0.01 g/L ADP (Amresco, ultra pure grade), 75 g/L sucrose (cane sugar), and 18 g/L fructose. The following reaction conditions were used: 50 mM potassium phosphate buffer, pH 6, 60° C. in a THERMOTRON® titre-plate shaker with 300 RPM shaking for 16-18 h. The reactions described above were solubilized by diluting 50× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. The resulting engineered sucrose synthase variants that showed improved activity in the one-pot reaction are listed in Table 27.1 and 99.2.

Shake-flask scale cultures were grown, lysed, and lyophilized to powder as described in Example 1 for variants listed in Table 27.3.

TABLE 27.1

SUS Combinatorial Variants and RebM Levels

| SEQ ID NO: (nt/aa) | Amino Acid Differences (Relative to SEQ ID NO: 2182) | Increased RebM[a] |
|---|---|---|
| 2309/2310 | T34E/A323G/T640A | ++ |
| 2311/2312 | T34E/V62I | ++ |
| 2313/2314 | N406G/T640R | ++ |
| 2315/2316 | T34E/T65C | ++ |
| 2317/2318 | T34E/T640A | ++ |
| 2319/2320 | A323G/T640A/D731Q | ++ |
| 2321/2322 | R38H/T640R | ++ |
| 2323/2324 | V62I/A63S/T65C/E528D/T640A | ++ |
| 2325/2326 | A323G/H526T/E528D/T640R | ++ |
| 2327/2328 | A63T/T65C/N406G/D731Q | ++ |
| 2329/2330 | A63T/T65C/A323G/N406G/H526T/E528D/T640N/D731Q | ++ |
| 2331/2332 | T34E/A63S/N406G/E528D/T640N/D731Q | + |
| 2333/2334 | A63S/D731Q | + |
| 2335/2336 | A63S/T65C/T640R | + |
| 2337/2338 | T34E/T65C/E528D/T640R | + |
| 2339/2340 | T34E/A63S/A323G/H526T/E528D/T640R | + |
| 2341/2342 | A63S/N406G | + |
| 2343/2344 | D731Q | + |
| 2345/2346 | A63S/A323G/N406G/T640A | + |
| 2347/2348 | A63S/H526T/E528D/T640R/D731Q | + |
| 2349/2350 | T34E/A323G/N406G/T640A | + |
| 2351/2352 | T34E/A63T/T65C/A323G/E528D/T640R | + |
| 2353/2354 | H526T/E528D/T640A/D731Q | + |
| 2355/2356 | T34E/V62I/T65C/T640R | + |
| 2357/2358 | V62I/A63S/H526T/T640R/D731Q | + |
| 2359/2360 | A323G/N406G/T640N | + |
| 2361/2362 | V62I/A63T/I69F/A323G/N406G/T640R | + |
| 2363/2364 | A63T/N406G/T640A | + |
| 2365/2366 | T34E/A63S/T65C/N406G/E528D/T640R/A713V | + |
| 2367/2368 | V62I/A323G/T640R | + |
| 2369/2370 | A323G/N406G/T640R/D731Q | + |
| 2371/2372 | T34E/T640R | + |
| 2373/2374 | A63T/T65C/E528D/T640A/D731Q | + |
| 2375/2376 | T34E/V62I/A323G | + |
| 2377/2378 | A323G/H526T/T640R | + |
| 2379/2380 | V62I/A63T | + |
| 2381/2382 | T34E | + |

[a]Levels of increased production were determined relative to the reference polypeptide of SEQ ID NO: 2182, and defined as follows: "+" = production at least that of the reference but less than 1.1-fold reference polypeptide; and "++" = at least 1.1-fold increased production relative to the reference polypeptide.

TABLE 27.2

SUS Saturation Mutagenesis Variants and RebM Levels

| SEQ ID NO: (nt/aa) | Amino Acid Differences (Relative to SEQ ID NO: 2182) | Increased RebM[a] |
|---|---|---|
| 2383/2384 | S102T | ++ |
| 2385/2386 | S30A | ++ |
| 2387/2388 | Q108R | ++ |
| 2389/2390 | R683V | ++ |
| 2391/2392 | L206I | ++ |
| 2393/2394 | P546N | ++ |
| 2395/2396 | A59T | ++ |
| 2397/2398 | R158A | ++ |
| 2399/2400 | Q37L | ++ |
| 2401/2402 | N183P | ++ |
| 2403/2404 | R158K | + |
| 2405/2406 | N307H | + |
| 2407/2408 | A164G | + |
| 2409/2410 | A409S | + |
| 2411/2412 | Q37M | + |
| 2413/2414 | E710S | + |
| 2415/2416 | Q311S | + |
| 2417/2418 | R28H | + |
| 2419/2420 | T191L | + |
| 2421/2422 | R683L | + |
| 2423/2424 | V235A | + |
| 2425/2426 | A164T | + |
| 2427/2428 | T419V | + |
| 2429/2430 | S30M | + |
| 2431/2432 | E710A | + |
| 2433/2434 | S30H/R158H | + |
| 2435/2436 | Q311L | + |
| 2437/2438 | S30Q | + |
| 2439/2440 | T419L | + |
| 2441/2442 | P546Q | + |
| 2443/2444 | E710V | + |
| 2445/2446 | E793G | + |
| 2447/2448 | G543A | + |
| 2449/2450 | N307E | + |
| 2451/2452 | L533R | + |
| 2453/2454 | K559R | + |
| 2455/2456 | A164Q | + |
| 2457/2458 | T752R | + |
| 2459/2460 | E710G | + |
| 2461/2462 | A164S | + |
| 2463/2464 | S102N | + |
| 2465/2466 | L533K | + |
| 2467/2468 | P546T | + |

[a]Levels of increased production were determined relative to the reference polypeptide of SEQ ID NO: 2182, and defined as follows: "+" = production at least 0.99-fold that of the reference but less than 1.1-fold reference polypeptide; and "++" = at least 1.1-fold increased production relative to the reference polypeptide.

Shake Flask Powder Characterization Assay and Analysis for Glucosyl Transfer from Sucrose to Rebaudioside A 60 to Form Rebaudioside M An experiment was performed to characterize the activity of some of the engineered SUS variants on sucrose and ADP to facilitate the formation of rebaudioside M from rebaudioside A 60%. Shake flask powder (SFP) was made up to 0.016-0.5 g/L in potassium phosphate buffer, pH 6 with and without 100 g/L RebA60, and the solutions with RebA60 were pre-incubated at 75° C. for 2 hours. 10 μL diluted, either pre-incubated or not pre-incubated SuS lysate, 0.2 g/L β1,2 GT SFP SEQ ID NO: 1216, and 0.43 g/L β1,3GT SFP SEQ ID NO: 520, were used in 100 μL reaction volume with 50 g/L RebA60, 0.01 g/L ADP (Amresco, ultra pure grade), 75 g/L sucrose (cane sugar), and 18 g/L fructose. The following reaction conditions were used: 50 mM potassium phosphate buffer, pH 6, 60° C. in a THERMOTRON® titre-plate shaker with 300 RPM shaking for 16-18 h. The reaction described above was solubilized by diluting 50× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. To assess thermostability, reactions were also performed with 10 μL of shake flask powders that had been dissolved at 0.2 g/L in 50 mM potassium phosphate buffer, pH 6 with 100 g/L RebA60, and incubated 24 h at 71.1° C. and then assayed in 100 μL reaction volume under the same one-pot reaction conditions described above. The thermostability results and production levels of rebaudioside M in the one-pot reactions by these variants at 0.0125 g/L SFP loading are shown in Table 27.3.

TABLE 27.3

SUS SFP Variants and RebM Levels

| SEQ ID NO: (nt/aa) | Amino Acid Differences (Relative to SEQ ID NO: 2182) | Increased RebM[a] | Increased RebM (pre-incubated)[a] | % Activity Remaining[b] |
|---|---|---|---|---|
| 2317/2318 | T34E/T640A | + | ++ | + |
| 2315/2316 | T34E/T65C | + | + | − |
| 2327/2328 | A63T/T65C/N406G/D731Q | + | + | ++ |
| 2321/2322 | R38H/T640R | + | + | + |
| 2311/2312 | T34E/V62I | + | + | + |
| 2309/2310 | T34E/A323G/T640A | − | + | ++ |

[a]Levels of increased production were determined relative to the reference polypeptide of SEQ ID NO: 2182, and defined as follows: "−" = production less than 0.9-fold that of the reference polypeptide; "+" = production at least 0.9-fold that of the reference but less than 1.1-fold reference polypeptide; and "++" = production at least 1.1-fold increased relative to that of the reference polypeptide.
[b]The percent of activity remaining for each variant was determined following 24 h pre-incubation at 71.1° C., relative to the production from each variant following 24 h pre-incubation at 65° C. and is defined as follows: "−" = less than 16% of activity remained following 24 h pre-incubation at 71.1° C.; "+" = at least 16% but less than 26% activity remained; and "++" = at least 26% activity remained.

All 6 variants listed in Table 27.3 performed similarly or better than SEQ ID NO: 2182 in both activity assays and in the 24 h pre-incubation assay. The most active variant in the one-pot assay without 2 h pre-incubation, SEQ ID NO: 2322, was selected as the starting point for further enzyme engineering.

Example 28

Sucrose Synthase Variants of SEQ ID NO: 2322

Directed evolution of the sucrose synthase encoded by SEQ ID NO: 2321 was continued by constructing libraries of variant genes in which certain structural features of the enzyme were subjected to saturation mutagenesis and libraries in which mutations associated with improved production identified during the development of the present invention were recombined. These libraries were then plated, grown, and screened using the high-throughput (HTP) assay described below, to provide an additional round of 18 engineered SuS variant polypeptides with increased activity toward the generation of ADP-glucose.

HTP Coupled Assay for Glucose Transfer from Sucrose to ADP to Rebaudioside A 60 to Form Rebaudioside M Libraries were screened using the following HTP enzyme-coupled assay. Pelleted E. coli cultures were lysed with 400 μL of Tris-HCl, pH 7.5 with 1 mM magnesium sulfate and 0.5 mg/mL lysozyme and polymyxin B sulfate (PMBS) and cleared by centrifugation. Lysate was diluted 100× into potassium phosphate buffer, pH 6.0 with 100 g/L RebA60 and pre-incubated for 2 hour at 75° C. Then, 10 μL diluted, pre-incubated SuS lysate, 0.4 g/L β1,2GT SFP SEQ ID NO: 1516, and 0.9 g/L β1,3GT SFP SEQ ID NO: 678, were used in 100 µL reaction volume with 100 g/L RebA60, 0.05 g/L ADP (Amresco, ultra pure grade), 150 g/L sucrose (cane sugar), and 36 g/L fructose. The following reaction conditions were used: 50 mM potassium phosphate buffer, pH 6, 60° C. in a THERMOTRON® titre-plate shaker with 300 RPM shaking for 16-18 h. The reactions described above were solubilized by diluting 100× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. The resulting engineered sucrose synthase variants that showed improved activity in the one-pot reaction are listed in Table 28.1. Shake-flask scale cultures were grown, lysed, and lyophilized to powder as described in Example 1 for variants listed in Table 28.2.

TABLE 28.1

SUS Variants and RebM Levels

| SEQ ID NO: (nt/aa) | Amino Acid Differences (Relative to SEQ ID NO: 2322) | Increased RebM[a] |
|---|---|---|
| 2469/2470 | V62I/T65C/A323G/N406G/M565V/D731Q | + |
| 2471/2472 | A63T/T65C/A323G/N406G/M565V/D731Q | + |
| 2473/2474 | T34E/T65C/A323G/N406G/L411I/M565V | ++ |
| 2475/2476 | T34E/A323G/N406G/M565V/D731Q | + |
| 2477/2478 | V62I/T65C/N406G/L411I/M565V/D731Q | +++ |
| 2479/2480 | A323G/L411I/M565V | ++ |
| 2481/2482 | A63T/T65C/N406G/L411I/M565V | + |
| 2483/2484 | A323G/N406G/L411I/M565V | ++ |
| 2495/2486 | V62I/A323G/L411I/M565V | +++ |
| 2487/2488 | V62I/A323G/N406G/L411I/M565V | ++ |
| 2489/2490 | T34E/A323G/N406G/L411I/M565V | +++ |
| 2491/2492 | Q636H | + |
| 2493/2494 | Q636N | + |
| 2495/2496 | Q636A | + |
| 2497/2498 | V62I/T65C/A323G/N406G/M565V | +++ |
| 2499/2500 | V62I/A323G/N406G/L411I | ++ |
| 2501/2502 | V62I/T65C/A323G/L411I/M565V | + |
| 2503/2504 | T65C/A323G/N406G/M565V | + |

[a]Levels of increased production were determined relative to the reference polypeptide of SEQ ID NO: 2322, and defined as follows: "+" = production at least 1.05-fold that of the reference but less than 1.34-fold reference polypeptide; "++" = at least 1.34-fold increased production but less than 1.39-fold increased production; and "+++" = at least 1.39-fold increased production relative to the reference polypeptide.

Shake Flask Powder Characterization Assay and Analysis for Glucosyl Transfer from Sucrose to Rebaudioside A 60 to Form Rebaudioside M An experiment was performed to characterize the activity of some of the engineered SUS variants on sucrose and ADP to facilitate the formation of rebaudioside M from rebaudioside A 60%. Shake flask powder (SFP) was made up to 0.125-2 g/L in potassium phosphate buffer, pH 6 with and without 100 g/L RebA60, and the solutions with RebA60 were pre-incubated at 75° C. for 2 hours. 10 µL diluted, either pre-incubated or not pre-incubated SuS lysate, 0.4 g/L β1,2 GT SFP SEQ ID NO: 1516, and 0.9 g/L β1,3GT SFP SEQ ID NO: 678, were used in 100 µL reaction volume with 100 g/L RebA60, 0.05 g/L ADP (Amresco, ultra pure grade), 150 g/L sucrose (cane sugar), and 36 g/L fructose. The following reaction conditions were used: 50 mM potassium phosphate buffer, pH 6, 60° C. in a THERMOTRON® titre-plate shaker with 300 RPM shaking for 16-18 h. The reaction described above was solubilized by diluting 100× in water, quenched by diluting 5× in acetonitrile with 0.2% formic acid, and precipitated by centrifugation. The supernatant was diluted 20× in water and steviol glycoside products were detected by RapidFire SPE-MS/MS with the instrument and parameters described in Table 5.1. To assess thermostability, reactions were also performed with 10 µL of crude clarified lysate that had been diluted 25× in 50 mM potassium phosphate buffer, pH 6 with 100 g/L RebA60, and incubated 24 h at 71.1° C. and was then assayed in 100 µL reaction volume under the same one-pot reaction conditions described above. The thermostability results and production levels of rebaudioside M in the one-pot reactions by these variants at 0.025 g/L SFP loading are shown in Table 28.2.

TABLE 28.2

SUS SFP Variants and RebM Levels

| SEQ ID NO: (nt/aa) | Amino Acid Differences (Relative to SEQ ID NO: 2322) | Increased RebM[a] | Increased RebM (pre-incubated)[a] | % Activity Remaining[b] |
|---|---|---|---|---|
| 2473/2474 | T34E/T65C/A323G/N406G/L411I/M565V | + | +++ | + |
| 2477/2478 | V62I/T65C/N406G/L411I/M565V/D731Q | + | +++ | ++ |
| 2485/2486 | V62I/A323G/L411I/M565V | ++ | ++ | − |
| 2487/2488 | V62I/A323G/N406G/L411I/M565V | + | +++ | + |
| 2489/2490 | T34E/A323G/N406G/L411I/M565V | + | +++ | − |
| 2497/2498 | V62I/T65C/A323G/N406G/M565V | ++ | ++ | − |
| 2499/2500 | V62I/A323G/N406G/L411I | + | ++ | + |
| 2505/2506 | V62I/T65C/N406G/L411I/M565V/Q636H/D731Q | + | + | ++ |

[a]Levels of increased production were determined relative to the reference polypeptide of SEQ ID NO: 2322, and defined as follows: "+" = production at least 1.15-fold that of the reference but less than 1.35-fold reference polypeptide; "++" = production at least 1.15-fold but less than 1.35-fold; and "+++" = production at least 1.35-fold increased relative to that of the reference polypeptide.
[b]The percent of activity remaining for each variant was determined following 24 h pre-incubation at 71.1° C., relative to the production from each variant following 24 h pre-incubation at 65° C. and is defined as follows: "−" = less than 44% of activity remained following 24 h pre-incubation at 71.1° C.; "+" = at least 44% but less than 54% activity remained; and "++" = at least 54% activity remained.

All 8 variants listed in Table 28.2 performed similarly or better than SEQ ID NO: 2322 in both activity assays and 3 of these were also more stable after 24 h pre-incubation at 71.1° C. in 100 g/L RebA60. Of the three more thermostable variants, the most active variant in the one-pot assays with and without 2 h pre-incubation was SEQ ID NO: 2478. This variant, SEQ ID NO: 2478, was further engineered by introducing the amino acid mutation Q636H to produce SEQ ID NO: 2505/2506. This enzyme, SEQ ID NO: 2506 was selected as the best enzyme for the catalysis of glycosyl-transfer from sucrose to ADP to regenerate ADP-glucose in the context of a one-pot reaction with a β-1,2-glycosyltransferase and a β-1,3-glycosyltransferase and for formation of rebaudioside M from steviol glycosides (e.g., rebaudioside A 60% or steviol glycosides 95% or steviol glycosides 85%).

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention.

SEQUENCE LISTING (2506 sequences)

SEQ ID NO: 1 - DNA, 1326 bp, Artificial Sequence
  UGT76G1 wild type
atggaaaataaaacggagaccaccgttcgccggcgccggagaataatattattcccggtaccatttcaaggccacattaacccaattcttcagctagccaatgtgttgtactctaaaggattcagtatcaccatctttcacaccaacttcaacaaacccaaaacatctaattaccctcacttcactttcagattcatcctcgacaacgacccacaagacgaacgcatttccaatctaccgactcatggtccgctcgctggtatgcggattccgattatcaacgaacacggagctgacgaattacgacgcgaactggaactgttgatgttagcttctgaagaagatgaagaggtatcgtgtttaatcacggatgctctttggtacttcgcgcaatctgttgctgacagtcttaacctccgacggcttgttttgatgacaagcagcttgtttaattttcatgcacatgtttcacttcctcagtttgatgagcttggttacctcgatcctgatgacaaaacccgtttggaagaacaagcgagtgggtttcctatgctaaaagtgaaagacatcaagtctgcgtattcgaactggcaaatactcaaagagatattagggaagatgataaaacaaacaagagcatcttcaggagtcatctggaactcatttaaggaactcgaagagtctgagctcgaaactgttatccgtgagatcccggctccaagtttcttgataccactccccaagcatttgacagcctcttccagcagcttactagaccacgatcgaaccgtttttcaatggttagaccaacaaccgccaagttcggtactgtatgttagttttggtagtactagtgaagtggatgagaaagatttcttggaaatagctcgtgggttggttgatagcaagcagtcgtttttatgggtggttcgacctgggtttgtcaagggttcgacgtgggtcgaaccgttgccagatgggttcttgggtgaaagaggacgtattgtgaaatgggttccacagcaagaagtgctagctcatggagcaataggcgcattctggactcatagcggatggaactctacgttggaaagcgtttgtgaaggtgttcctatgattttctcggattttgggctcgatcaaccgttgaatgctagatacatgagtgatgttttgaaggtaggggtgtatttggaaaatgggtgggaaagaggagagatagcaaatgcaataagaagagttatggtggatgaagaaggagaatacattagacagaatgcaagagttttgaaacaaaaggcagatgtttctttgatgaagggtggt

SEQ ID NO: 2 - protein, 442 aa, Artificial Sequence
  UGT76G1 wild type
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGG

SEQ ID NO: 3 - DNA, 1374 bp, Artificial Sequence
  Codon optimized UGT76G1
atggagaacaaaaccgaaaccaccgtgcgtcgtcgtcgtcgtatcattctgtttccggttccgttccagggccacatcaacccgattctgcaactggcgaacgtgctgtacagcaagggttttagcatcaccatttttcacaccaacttcaacaagccgaaaaccagcaactatccgcacttcacctttcgtttcatcctggacaacgatccgcaggacgagcgtattagcaacctgccgacccatggtccgctggcgggtatgcgtatcccgatcattaacgagcacggcgcggatgaactgcgtcgtgagctggaactgctgatgctggcgagcgaggaagacgaggaagttagctgcctgattaccgatgcgctgtggtacttcgcgcaaagcgtggcggacagcctgaacctgcgtcgtctggttctgatgaccagcagcctgtttaacttccacgcgcacgtgagcctgccgcagtttgacgagctgggctacctggatccggacgataaaacccgtctggaggaacaagcgagcggtttcccgatgctgaaggttaaagatatcaagagcgcgtatagcaactggcagatcctgaaagaaattctgggcaagatgatcaagcagacccgtgcgagcagcggtgtgatttggaacagctttaaagagctggaggaaagcgagctggaaaccgttatccgtgaaattccggcgccgagcttcctgattccgctgccgaagcacctgaccgcgagcagcagcagcctgctggaccacgatcgtaccgtgttccagtggctggaccagcaaccgccgagcagcgtgctgtacgttagctttggcagcaccagcgaggtggacgaaaaggatttcctggagattgcgcgtggtctggttgacagcaaacaaagctttctgtgggtggttcgtccgggcttcgtgaagggtagcacctgggttgagccgctgccggatggttttctgggcgaacgtggtcgtatcgtgaagtgggttccgcaacaagaagtgctggcgcacggcgcgattggtgcgttctggacccacagcggttggaacagcaccctggagagcgtgtgcgaaggcgttccgatgatctttagcgacttcggtctggatcagccgctgaacgcgcgttacatgagcgatgttctgaaagtgggcgtttatctggagaacggctgggagcgtggtgaaatcgcgaacgcgattcgtcgtgtgatggttgacgaggaaggtgagtacatccgtcagaacgcgcgtgttctgaagcaaaaagcggatgttagcctgatgaagggtggcagcagctacgagagcctggaaagcctggttagctatattagcagcctg

SEQ ID NO: 4 - protein, 458 aa, Artificial Sequence
  UGT76G1 wild type
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTRASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 5 - DNA, 2415 bp, Artificial Sequence
  Codon optimized Acidithiobacillus caldus sucrose synthase
atgcaccatcatcatcatcatggcggtagcggcatgattgaagcactgcgccaacagctgctggatgatccacgttcatggtacgcattcctgcgtcatttagtcgcatctcagcgtgactcatggttatatacggatttacagcgcgcgtgcgcggattttcgcgaacagctgccggaaggctatgcagaaggtattggtccgctcgaagattttgtggcacatacccaggaagtgatcttccgtgatccgtggatggtttttgcgtggcgtccacgtccaggtcgttggatttatgtgcgcattcatcgtgaacagctggccctggaggagctgagcactgatgcctatctgcaagccaaagaaggcatcgttggcttaggtgcagaaggtgaagcagttctgacggtggatttccgcgattttcgtccggttagccgtcgtttacgcgacgagagcaccattggtgatggtcttacccatctgaatcgtcgtttagcaggtcgcatctttagcgatttagcagcaggtcgtagtcagatcctggaatttctgagcctgcatcgtctggatggtcagaatctgatgctgagcaacggcaataccgattttgactctttacgtcaaaccgtacagtatctgggcaccttaccacgtgaaactccgtgggcagagattcgtgaagacatgcgtcgtcgtggttttgcaccaggttggggcaacaccgcgggccgtgttcgcgaaaccatgcgtctgctgatggatctgcttgactctccgagcccagctgccctggagagcttcctggatcgcatcccgatgattagccgcatcctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgtaggtgccgagaatgtgcagattctgcgcgttccgtttcgctatccagatggtcgtattcacccgcattggatctcacgcttcaagatttggccgtggcttgaacgctatgcacaggatctggaacgcgaagttctggccgaattaggtagtcgtccagatctgatcatcggcaactatagcgacggtaatctggttgcaaccctgctgtcagaacgcttaggtgttacgcagtgcaacattgcacatgccctggagaaaagcaagtacctgtactccgatctgcattggcgcgatcatgaacaggaccatcactttgcatgtcagtttaccgcggatctgatcgcgatgaatgcagcagacatcatcgtgacgagcacataccaggaaattgcaggtaatgaccgcgagatcggtcaatatgaaggtcaccaggactatactttaccgggcttgtatcgtgtcgagaatggtattgacgtgttcgatagcaagtttaacattgtgagtccgggcgcagatccacgcttttattttagctatgcacgtactgaagaacgcccatcgttcctggagccagaaatcgaaagtctgctgtttggccgcgaaccaggtgcagatcgtcgtggtgttctcgaagatcgccagaaaccgctgctgctgtcgatggcccgtatggatcgcatcaagaacctgagcggtctggccgaactgtatggtcgtagttctcgcttacgtggtctggccaatttggtgatcatcggtggtcatgttgatgtgggcaatagtcgcgatgcagaagaacgcgaagaaatccgtcgtatgcacgagatcatggaccattaccagctggatggtcagctgcgttgggtgggagcactgctggataaaaccgtggcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccatgaagcgaccgcagaacgtctggccgacttcctggaagcagcgcgtgaacgtccgaaatattggcttgaaattagcgatgcggctcttgcgcgcgtcgcggaacgttacacgtgggagcgctatgcggaacgcttgatgaccatcgcgcgtatcttcggcttttggcgcttcgttctggatcgcgaatcacaggtcatggaacgctatctgcaaatgttccgccacctgcaatggcgcccgctggctcatgccgtaccgatggagtaa

SEQ ID NO: 6 - protein, 804 aa, Artificial Sequence
  Codon optimized Acidithiobacillus caldus sucrose synthase
MHHHHHHGGSGMIEALRQQLLDDPRSWYAFLRHLVASQRDSWLYTDLQRACADFREQLPEGYAEGIGPLEDFVAHTQEVIFRDPWMVFAWRPRPGRWIYVRIHREQLALEELSTDAYLQAKEGIVGLGAEGEAVLTVDFRDFRPVSRRLRDESTIGDGLTHLNRRLAGRIFSDLAAGRSQILEFLSLHRLDGQNLMLSNGNTDFDSLRQTVQYLGTLPRETPWAEIREDMRRRGFAPGWGNTAGRVRETMRLLMDLLDSPSPAALESFLDRIPMISRILIVSIHGWFAQDKVLGRPDTGGQVVYILDQARALEREMRNRLRQQGVDVEPRILIATRLIPESDGTTCDQRLEPVVGAENVQILRVPFRYPDGRIHPHWISRFKIWPWLERYAQDLEREVLAELGSRPDLIIGNYSDGNLVATLLSERLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADPRFYFSYARTEERPSFLEPEIESLLFGREPGADRRGVLEDRQKPLLLSMARMDRIKNLSGLAELYGRSSRLRGLANLVIIGGHVDVGNSRDAEEREEIRRMHEIMDHYQLDGQLRWVGALLDKTVAGELYRVVADGRGVFVQPALFEAFGLTVIEAMSSGLPVFATRFGGPLEIIEDGVSGFHIDPNDHEATAERLADFLEAARERPKYWLEISDAALARVAERYTWERYAERLMTIARIFGFWRFVLDRESQVMERYLQMFRHLQWRPLAHAVPME

SEQ ID NO: 7 - DNA, 1371 bp, Artificial Sequence
  ADP-Glycosyltransferase Variant
atggagaacaaaaccgaaaccaccgtgcgtcgtcgtcgtgttattctgtttccggttccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggcttcgcaacctgccgacccatggtccgggcgcgggttggcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagattgcgaaagaaattctggataagatgattaagcagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaaaaggatttcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtgtgatggttgaccgtgaaggtgaggtgatgcgtcaaaacgcggcggttctgaaggataaagcggatgtgagcctggctaagggtggcagcagctacgagagcctggaaagcctggttagctatattagcagcctg

SEQ ID NO: 8 - protein, 457 aa, Artificial Sequence
  ADP-Glycosyltransferase Variant
MENKTETTVRRRRVILFPVPFPGHINPMLQLANVLYSRGFSITIFHTNFNKPKTSNYPHFTFRFILDNDPQDEWLRNLPTHGPGAGWRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMIKQTRASSGVIWNSFKELEESELETVWREIPAPSFLIPLPKHLRASSSSLLDHDPTVFQWLDQQPPSSVLYVSFGSQSEVDEKDFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRVMVDREGEVMRQNAAVLKDKADVSLAKGGSSYESLESLVSYISSL

SEQ ID NO: 9 - DNA, 1371 bp, Artificial Sequence
  ADP-Glycosyltransferase Variant
atggagaacaaaaccgaaaccaccgtgcgtcgtcgtcgtgttattctgtttccggtgccgttcccgggccacatcaacccgatgctgcaactggcgaacgtgctgtacagcagaggttttagcatcaccatttttcacaccaacttcaacaagccgaaaaccagcaactatccgcacttcacctttcgttttatcttggacaacgatccgcaggacgagtggattagcaacctgccgacccatggtccgggcgcgggtatgcgtatcccgatcattaacgagcacggcgcggatgaattccgtaaagagctggaaagcctgatgcgggcgagcccggaagacgaggaagttgcgtgcctgattaccgatgcgctgtggtacttcgcgcaaccggtggcggacagcctgaacctgccgcgtctggttctgatgaccagcagcctgtttaacttccacgcgctggtgtcgctgccgcaatttttagagcttggctacctggatccgggtgataaaacccgtctggaggaacaagtggtaggtttcccgatgctgaaggttaaagatatcaagcgcgcgtatagcaattggcagatcgcgaaagaaattctggataagatgcttgcccagacccgtgcgagcagcggtgtgatttggaacagctttaaagagctggaggaaagcgagctggaaaccgtttggcgtgaaattccggcgccgagcttcctgattccgctgccgaagcacctgagggcgagcagcagcagcctgctggaccacgatccgaccgtgttccagtggctggaccagcaaccgccgagcagcgtgctgtacgttagctttggcagccagagcgaggtggacgaatcagaattcctggagattgcgcgtggtctggttgacagcaaacaaagctttctgtggcgcgttcgtccgggcttcgtgaagggtagcgagtgggttgagccgctgccggatggttttctgggcgaacgtggtcgtatcgtgaagtctgttccgcaacaagaagtgctggcgcacgatgcgattggtgcgttctggacccacggcggttggaacggcaccctggagagcgtgtgcgaaggcgttccgatgatctttagcgatttcggtctggatcagccgctgaacgcgcgttacatgagcgatgttctgaaagtgggcgtttatctggagaacggctgggagcgtggtgaaatcgaaaacgcgattcgtcgtctgatggttgaccgtgaaggtgaggtgatgcgtcaaaacgcggcggttctgaaggataaagcggatcagagcctggctaagggtggcagcagctacgagagcctggaaagcctggttagctatattagcagcctg

SEQ ID NO: 10 - protein, 457 aa, Artificial Sequence
  ADP-Glycosyltransferase Varian
MENKTETTVRRRRVILFPVPFPGHINPMLQLANVLYSRGFSITIFHTNFNKPKTSNYPHFTFRFILDNDPQDEWISNLPTHGPGAGMRIPIINEHGADEFRKELESLMRASPEDEEVACLITDALWYFAQPVADSLNLPRLVLMTSSLFNFHALVSLPQFLELGYLDPGDKTRLEEQVVGFPMLKVKDIKRAYSNWQIAKEILDKMLAQTRASSGVIWNSFKELEESELETVWREIPAPSFLIPLPKHLRASSSSLLDHDPTVFQWLDQQPPSSVLYVSFGSQSEVDESEFLEIARGLVDSKQSFLWRVRPGFVKGSEWVEPLPDGFLGERGRIVKSVPQQEVLAHDAIGAFWTHGGWNGTLESVCEGVPMIFSDFGLDQPLNARYMSDVLKVGVYLENGWERGEIENAIRRLMVDREGEVMRQNAAVLKDKADQSLAKGGSSYESLESLVSYISSL

SEQ ID NO: 11 - DNA, 1356 bp, Artificial Sequence
  codon-optimized Solanum tuberosum glycosyltransferase
atgcaccatcatcatcatcatggcggtagcggcgctaccctgcgcgtactgatgtttccgtggcttgcgtatggtcatatttctccgtttttgaatatcgctaaacaactggccgatcgtggtttcctgatctatttatgcagtaccctgattaacctcgaaagcattatcaagaagatcccggagaaatacagtgagagcatccgttttgtggagctgcatctgccagaattaccggaactgccaccacattaccatactaccaacggtttaccaccgcatctgaaccataccctgcacaaggcactgaagatgagcaagccgaactttagcaagatcctgcaaaacctgaagccggacctggtcatctacgatattctgcaaccgtgggcagaacatgtcgtaaacgaacagaacatcccggctgttaagattctgaccagtggtgcggcactgtttagctactttttcaacttcctgaagaatccgggtgtagaatttccgtttccggcgatctacctgcctaaggtggaacaggtgaagatgcgcgagatgtttgaaaaggagccgaacgaagaagatcgcttagcagaaggcaatatgcagatcatgctgatgtgcacgagccgcaccattgaggctaagtacctggactattgcaccgaactgagcaattggaaagttgttccggttggtccgccatttcaggacccgattactaatgatgttgacgacatggaactgattgattggttaggcaccaaagacgagaacagtacggtctttgtgtgctttggcagcgagtacttcctgagccgtgaagacatggaagaagtcgcgttcggcctggagctgagcaacgtgaactttatctgggttgcacgctttccgaaaggcgaggaacagaatctggaagacgttctgccaaaaggcttcctggaacgcattggtgaacgtggtcgcgttctggacaagtttgcaccgcagccacgtattctgaaccatccgagcacgggtggcttcatctctcattgcggttggaacagcgtcatggaaagcctggattttggcgttccgatcattgcgatgccgatgcacaacgatcagccgattaacgcgaagctgatcgtggaattaggcgttgcaatggagatcgtgcgtgatgacgatggcaacattcaccgcggcgaaattacggaaaccctgaaagatgtgattaccggcgaaactggtgagatcctgcgcggcaaagtacgcgacattagcaagaacctgaagagcattcgcgaggaagaaatgaatgcagcggcggaagaactgatccagctgtgtcgcaacagcaacaagtacaagtaa

SEQ ID NO: 12 - protein, 451 aa, Artificial Sequence
  codon-optimized Solanum tuberosum glycosyltransferase
MHHHHHHGGSGATLRVLMFPWLAYGHISPFLNIAKQLADRGFLIYLCSTLINLESIIKKIPEKYSESIRFVELHLPELPELPPHYHTTNGLPPHLNHTLHKALKMSKPNFSKILQNLKPDLVIYDILQPWAEHVVNEQNIPAVKILTSGAALFSYFFNFLKNPGVEFPFPAIYLPKVEQVKMREMFEKEPNEEDRLAEGNMQIMLMCTSRTIEAKYLDYCTELSNWKVVPVGPPFQDPITNDVDDMELIDWLGTKDENSTVFVCFGSEYFLSREDMEEVAFGLELSNVNFIWVARFPKGEEQNLEDVLPKGFLERIGERGRVLDKFAPQPRILNHPSTGGFISHCGWNSVMESLDFGVPIIAMPMHNDQPINAKLIVELGVAMEIVRDDDGNIHRGEITETLKDVITGETGEILRGKVRDISKNLKSIREEEMNAAAEELIQLCRNSNKYK

SEQ ID NO: 13 - DNA, 1350 bp, Artificial Sequence
  Variant of ADP-beta-1,2-glycosyltransferase
atgcaccatcatcatgaaggcggtagcggctcgaccctgagagtactgatgtttccgtggcttgcgctgggtcatattaacccgtttttgcgtatcgctaaacaactggccgatcgtggtttcctgatctatttatgcagtaccctgattaacctcgaaagcatcaaaaagaagatcccggagaaatacagtgagagcatccatctggttgagctgcatctgccagaattaccggaactgccaccacattaccatactaccaacggtttaccaccgcatctgaacgggaccctgcacaaggcactgaagatgagcaagccgaactttagcaagatcctgcaaaacctgaagccggacctggtcatctacgattttctgcaaccgtgggcagaacatgtcgtgaacgaacagaacatcccggctgttaaaattctaaccagtggtgcggcactgtttagctactttttcaacttcctgaagcgaccgggtgtagaatttccgtttccggcgatcaacctgtcgaaggtggaacaggtgaagatgcgcgagatgtttgaaaaggagccggatgaagaagatccgttagcacctggcaatggaggtatcatgctgatgtgcacgagccgcgaaattgaggctaagtacctggactattgcaccgaactgagcaatgtaaaagttgttccggttggtccgccatttcaggacccgatgaccaatgatgcggacgacaaagaactgattgattggttaggtaccaaagacgagaacagtgttgtctatgtgtcgtttggcagcgaatacttcctgagccgtgaagatatggaagaagtcgcgttcggcctggagctgagcaacgtgaactttatctgggttgcacgctttccgaaaggcgaggaacagaatctggaagacgttctgccaaaaggcttcctggaacgcgttggtgatcgtggtcgcgttgtggaccatatggtgccgcaggcccatattctgaaccatccgagcacgggtggcttcatctctcattgcggttggaacagcgtcatggaaagcattgattttggcgttccgatcattgcgatgccgatgcagtgggatcagccgattaacgcgaagctgatcgtggaattaggcgttgcagtggagatcgtgcgtgatgaagatggcaacattcaccgcggcgaaattgcccaaacccttaaagatgtgattaccggcgaaactggtgagatcctgcgcggcaaagtacgcgacattagcaaaaacctgaagagcattcgcgaggaagaaatgaatgcagcggcggaagaactgatccagctgtgtcgcaacagcaacaagtacaag

SEQ ID NO: 14 - protein, 450 aa, Artificial Sequence
  Variant of ADP-beta-1,2-glycosyltransferase
MHHHHEGGSGSTLRVLMFPWLALGHINPFLRIAKQLADRGFLIYLCSTLINLESIKKKIPEKYSESIHLVELHLPELPELPPHYHTTNGLPPHLNGTLHKALKMSKPNFSKILQNLKPDLVIYDFLQPWAEHVVNEQNIPAVKILTSGAALFSYFFNFLKRPGVEFPFPAINLSKVEQVKMREMFEKEPDEEDPLAPGNGGIMLMCTSREIEAKYLDYCTELSNVKVVPVGPPFQDPMTNDADDKELIDWLGTKDENSVVYVSFGSEYFLSREDMEEVAFGLELSNVNFIWVARFPKGEEQNLEDVLPKGFLERVGDRGRVVDHMVPQAHILNHPSTGGFISHCGWNSVMESIDFGVPIIAMPMQWDQPINAKLIVELGVAVEIVRDEDGNIHRGEIAQTLKDVITGETGEILRGKVRDISKNLKSIREEEMNAAAEELIQLCRNSNKYK

SEQ ID NO: 15 - DNA, 1350 bp, Artificial Sequence
  Variant of ADP-beta-1,2-glucosyltransferase
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtgggagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgccaagaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaggcgcaatgccaagaag

SEQ ID NO: 16 - protein, 450 aa, Artificial Sequence
  Variant of ADP-beta-1,2-glucosyltransferase
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCQELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRRRNAKK

SEQ ID NO: 17 - DNA, 1371 bp, Artificial Sequence
  Variant of ADP-beta-1,3-glucosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgctgattaactgtcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcaacgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 18 - protein, 457 aa, Artificial Sequence
  Variant of ADP-beta-1,3-glucosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPLINCHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 19 - DNA, 1371 bp, Artificial Sequence
  Variant of ADP-beta-1,3-glucosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 20 - protein, 457 aa, Artificial Sequence
  Variant of ADP-beta-1,3-glucosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 21 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 22 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 23 - DNA, 1350 bp, Artificial Sequence
  Variant of ADP-beta-1,2-glucosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 24 - protein, 450 aa, Artificial Sequence
  Variant of ADP-beta-1,2-glucosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 25 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagaccgagtggcttcgcaacctgccgaccaccggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaccgtctggttctgcagaccagcagcctgtttaacttccacgcgctggtgtgcctgccgaaatttttagagctgggctacctggatccggaagataaacatcgtccggaggaaccggtggtaggtttcccgatgctgaaggttaaagatatccgtcgcgcgtatagccaatggcaagaagctcgcccaattctgacgaagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 26 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTTGPGAGARIPQINKHGADEFRKELESAMRDSPSDEEVACVITDALWYFAQPVADSLNLNRLVLQTSSLFNFHALVCLPKFLELGYLDPEDKHRPEEPVVGFPMLKVKDIRRAYSQWQEARPILTKMVEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 27 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagacggagtggcttcgcaacctgccgaccaccggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggaaagaagctcgcccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 28 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWKEARPILDKMVEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 29 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 30 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 31 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaagcgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaagccaattctggataagatgattgaagaaacccgtgccagcagcggtgtgatttggaacagctttaaagagctggaggaaagcgagctggaaaccgttacccgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgttccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 32 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVTREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSVPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 33 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaagcgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgttccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 34 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSVPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 35 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 36 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 37 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagacggagtggcttagtaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaagcgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggaaagaagctcgcccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 38 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLSNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWKEARPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 39 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctcgcccaattctgacgaagatggttgaagaaacccgtgccagcagcggtgtgatttggaacagctttaaagagctggaggaaagcgagctggaaaccgttacccgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 40 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEARPILTKMVEETRASSGVIWNSFKELEESELETVTREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 41 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgaccaccggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaagcgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgtccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 42 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTTGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 43 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagctgggctacctggatccggaagataaacatcgtccggaggaaccggtggtaggtttcccgatgctgaaggttaaagatatccgtcgcgcgtatagccactggcaagaagctcgcccaattctgacgaagatggttgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 44 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEARPILTKMVEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 45 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagccggagtggcttcgcaacctgccgaccaccggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccaatggcaagaagctaagccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 46 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSQWQEAKPILDKMIEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 47 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctgtatccgcacttcgattttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatactgatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcatcaacgcgattcgccgtgtgatggttgacccggaaggtgaggttatgcgtcaaaacgcgcgtatcttgaaggacaagttggatcgaagcattgctcccggtggcagcagctacgagagcctggaacgcctggttagctatattagcagcctg

SEQ ID NO: 48 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFDFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARILKDKLDRSIAPGGSSYESLERLVSYISSL

SEQ ID NO: 49 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttacccgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgttccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 50 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVTREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSVPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 51 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 52 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 53 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttacccgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 54 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVTREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 55 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgttccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 56 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSVPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 57 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagacggagtggcttagtaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggaaagaagctaagccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 58 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLSNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWKEAKPILDKMVEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 59 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagaccgagtggcttcgcaacctgccgaccaccggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaagccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgttccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 60 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSVPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 61 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgttccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 62 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSVPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 63 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaccgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 64 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLNRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 65 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaagcgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttacccgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgtccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 66 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVTREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 67 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagacggagtggcttagtaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccaatggaaagaagctaagccaattctgacgaagatggttgaagaaacccgtgccagcagcggtgtgatttggaacagctttaaagagctggaggaaagcgagctggaaaccgttacccgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgtccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 68 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLSNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSQWKEAKPILTKMVEETRASSGVIWNSFKELEESELETVTREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 69 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagccggagtggcttagtaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagaggcgggctacctggatccggaagataaacatcgtccggaggaaccggtggtaggtttcccgatgctgaaggttaaagatatccgtcgcgcgtatagccactggaaagaagctaagccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 70 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLSNLPTHGPGAGARIPQINKHGADEFRKELESAMRDSPSDEEVACVITDALWYFAQPVADSLNLKRLVLMTSSLFNFHALVCLPKFLEAGYLDPEDKHRPEEPVVGFPMLKVKDIRRAYSHWKEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 71 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaagcgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaagccaattctggataagatggttgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 72 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 73 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagccggagtggcttactaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggaaagaagctaagccaattctgacgaagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 74 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLTNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWKEAKPILTKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 75 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagaggcgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttacccgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 76 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLEAGYLDPEDKHRPEEPVVGFPMLKVKDIRRAYSHWQEAKPILDKMIEETRASSGVIWNSFKELEESELETVTREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 77 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagccggagtggcttagtaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaagccaattctggataagatggttgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgttccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 78 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLSNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSVPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 79 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagccggagtggcttagtaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 80 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLSNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 81 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 82 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 83 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagccggagtggcttactaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaagcgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgtccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 84 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLTNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 85 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagacggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagctgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttacccgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgtccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 86 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVTREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 87 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagccggagtggcttactaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaagccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 88 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLTNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 89 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagccggagtggcttactaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccaatggcaagaagctaagccaattctggataagatgattgaagaaacccgtgccagcagcggtgtgatttggaacagctttaaagagctggaggaaagcgagctggaaaccgttacccgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 90 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLTNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSQWQEAKPILDKMIEETRASSGVIWNSFKELEESELETVTREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 91 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagccggagtggcttcgcaacctgccgaccaccggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 92 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 93 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaccgtctggttctgatgaccagcagcctgtttaacttccacgcgctggtgtgcctgccgaaatttttagagctgggctacctggatccggaagataaacatcgtccggaggaaccggtggtaggtttcccgatgctgaaggttaaagatatccgtcgcgcgtatagccaatggcaagaagctaagccaattctgacgaagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 94 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQPEWLRNLPTHGPGAGARIPQINKHGADEFRKELESAMRDSPSDEEVACVITDALWYFAQPVADSLNLNRLVLMTSSLFNFHALVCLPKFLELGYLDPEDKHRPEEPVVGFPMLKVKDIRRAYSQWQEAKPILTKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 95 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagacggagtggcttagtaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttacccgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 96 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLSNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVTREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 97 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcaatcaccattctgcacaccaacttcaacgccccgaaaaccagcctttatccgcacttccagtttcgttttatcttggacaacgatccgcagaccgagtggcttcgcaacctgccgaccaccggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgttccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 98 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSVPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 99 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcgattttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 100 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFDFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 101 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctgtatccgcacttcgagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 102 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFEFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAITRVMVDPEGEVMRQNARKLKDKLDRSIAPGGSSYESLERLVSYISSL

SEQ ID NO: 103 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctgtatccgcacttcgattttcgttttatcttggacaacgatccgcagaccgagtggcttcgcaacctgccgacccatggtccgggcgcgggtaagcgtatcccgctgattaacaaacacggcgcggatgaattccgtaaagagctggaaagcctgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 104 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFDFRFILDNDPQTEWLRNLPTHGPGAGKRIPLINKHGADEFRKELESLMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 105 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctgtatccgcacttcgagtttcgttttatcttggacaacgatccgcagaccgagtggcttcgcaacctgccgacccatggtccgggcgcgggtgcgcgtatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaagttgaagatgaagttggatcgaagcattgctcccggtggcagcagctacgagagcctggaacgcctggttagctatattagcagcctg

SEQ ID NO: 106 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFEFRFILDNDPQTEWLRNLPTHGPGAGARIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKMKLDRSIAPGGSSYESLERLVSYISSL

SEQ ID NO: 107 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctgtatccgcacttcgattttcgttttatcttggacaacgatccgcagaccgagtggcttcgcaacctgccgacccatggtccgggcgcgggtaagcgtatcccgctgattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgtctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatactgatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 108 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFDFRFILDNDPQTEWLRNLPTHGPGAGKRIPLINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 109 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctgtatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgtgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatactgatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 110 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESVMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 111 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctgtatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgtgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaggatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 112 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESVMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 113 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctgtatccgcacttcgattttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcaccaacgcgattcgccgtgtgatggttgacccggaaggtgaggttatgcgtcaaaacgcgcgtatcttgaaggacaagttggatcgaagcattgctcccggtggcagcagctacgagagcctggaacgcctggttagctatattagcagcctg

SEQ ID NO: 114 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFDFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEITNAIRRVMVDPEGEVMRQNARILKDKLDRSIAPGGSSYESLERLVSYISSL

SEQ ID NO: 115 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctgtatccgcacttcgattttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgtgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 116 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFDFRFILDNDPQTEWLRNLPTHGPGAGARIPQINKHGADEFRKELESVMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 117 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgagtctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcaccaacgcgattcgccgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 118 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVSLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEITNAIRRVMVDPEGEVMRQNARKLKDKLDRSIAPGGSSYESLERLVSYISSL

SEQ ID NO: 119 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatactgatccgagcaccgcccaatggctggaccagcaaccgccgagcagcgtgctgtacgttggctttggcagccagagcgaggtggaccccaaggatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 120 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 121 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctgtatccgcacttcgagtttcgttttatcttggacaacgatccgcagaccgagtggcttcgcaacctgccgacccatggtccgggcgcgggtaagcgtatcccgctgattaacaaacacggcgcggatgaattccgtaaagagctggaaagcgtgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 122 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFEFRFILDNDPQTEWLRNLPTHGPGAGKRIPLINKHGADEFRKELESVMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 123 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgtgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 124 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGVGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 125 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccttggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 126 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTLGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 127 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatcctctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 128 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDPLWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 129 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgcctcatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 130 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPPHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 131 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgaccgcgggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 132 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTAGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 133 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgaccatgggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 134 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTMGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 135 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgaccgttggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagaaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 136 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTVGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQKPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 137 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgaccacgggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 138 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 139 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgaccgttggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 140 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTVGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 141 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgagcttgaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 142 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSELDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 143 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacctcgggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 144 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTSGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 145 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccggatcatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 146 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPDHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 147 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcacgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 148 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGTGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 149 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtgatggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 150 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGDGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 151 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccggggaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 152 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPGTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 153 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgttgatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 154 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGVDEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 155 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcaagctg

SEQ ID NO: 156 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISKL

SEQ ID NO: 157 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtcgtgttatgcgtcaaaacgcgcgtaaattgaaggataagttggatcgaagcattgctcccggtggcagcagctacgagagcctggaacgcctggttagctatattagcagcctg

SEQ ID NO: 158 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGRVMRQNARKLKDKLDRSIAPGGSSYESLERLVSYISSL

SEQ ID NO: 159 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagctgtgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 160 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSCAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 161 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtgtggtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 162 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRVVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 163 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgactaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 164 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPTTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 165 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgcagcatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 166 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPQHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 167 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcattcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 168 - protein, 457 aa, Artificial Sequence
  Variant of ADP-beta-1,3-glycosyltransferase
MPNTSPTTVRRRRVILFPVPFPGHLNPMLQLANVLYRRGFAITILHTNFNAPKTSLYPHFQFRFILDNDPQTEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLVSYISSL

SEQ ID NO: 169 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 170 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 171 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttttgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatacggatccgagcaccgcccaatggctggaccagcaaccgccgagcagcgtgctgtacgttggctttggcagccagagcgaagtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctggttagctatattagcagcctg

SEQ ID NO: 172 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRAPSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLVSYISSL

SEQ ID NO: 173 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 174 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 175 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 176 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 177 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatacggatccgagcaccgcccaatggctggaccagcaaccgccgagcagcgtgctgtacgttggctttggcagccagagcgaagtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 178 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRAPSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 179 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 180 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 181 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 182 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 183 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgaccacgggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 184 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTTGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 185 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatacggatccgagcaccgcccaatggctggaccagcaaccgccgagcagcgtgctgtacgttggctttggcagccagagcgaagtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 186 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRAPSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 187 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 188 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 189 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 190 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 191 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctggttagctatattagcagcctg

SEQ ID NO: 192 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRAPSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLVSYISSL

SEQ ID NO: 193 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 194 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 195 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctatggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 196 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 197 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 198 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 199 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 200 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 201 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 202 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 203 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgaccacgggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagcgaagtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 204 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 205 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 206 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 207 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgaccacgggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 208 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTTGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 209 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgacccatggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 210 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTHGPGAGARIPQINKHGADEFRKELESAMRDTPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 211 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatgaggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 212 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRAPSSSLLDEDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 213 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctggttagctatattagcagcctg

SEQ ID NO: 214 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLVSYISSL

SEQ ID NO: 215 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 216 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 217 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 218 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 219 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 220 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 221 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatacggatccgagcaccgcccaatggctggaccagcaaccgccgagcagcgtgctgtacgttggctttggcagccagagcgaagtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 222 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRAPSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 223 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 224 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 225 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 226 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 227 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 228 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 229 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 230 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 231 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 232 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRAPSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 233 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 234 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRAPSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 235 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 236 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 237 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 238 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 239 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 240 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 241 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 242 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRAPSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 243 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatacggatccgagcaccgcccaatggctggaccagcaaccgccgagcagcgtgctgtacgttggctttggcagccagagcgaagtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 244 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 245 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 246 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRAPSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 247 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 248 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 249 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 250 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRAPSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 251 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgaccacgggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 252 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 253 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 254 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRAPSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 255 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 256 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 257 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 258 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 259 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatgaggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 260 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRAPSSSLLDEDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 261 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 262 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 263 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 264 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 265 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 266 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 267 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgaccacgggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacattcgtaaattgaaggataagttggatcgaagcattgctcccggtggcagcagctacgagagcctggaacgcctgcagagctatattagcagcctg

SEQ ID NO: 268 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNIRKLKDKLDRSIAPGGSSYESLERLQSYISSL

SEQ ID NO: 269 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgccgagcagcagcctgctggatacggatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 270 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRAPSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 271 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 272 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 273 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacccatggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 274 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTHGPGAGARIPQINKHGADEFRKELESAMRDTPSDEEVACVITDALWYFAQPVADSLNLKRLVLMTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 275 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccgagctggttacgcaacctgccgaccacgggtccgggcgcgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcaaccgccgagcagcgtgctgtacgttggctttggcagccagagcgaagtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 276 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPSWLRNLPTTGPGAGARIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVQREIPAPSFLLPLPKHYRASSSSLLDTDPSTAQWLDQQPPSSVLYVGFGSQSEVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 277 - DNA, 1371 bp, Artificial Sequence
  Variant of ADP-beta-1,3-glycosyltransferase
atgccaaatactagtccgactactgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 278 - protein, 457 aa, Artificial Sequence; identical to SEQ ID NO: 36
  Variant of ADP-beta-1,3-glycosyltransferase

SEQ ID NO: 279 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 280 - protein, 457 aa, Artificial Sequence; identical to SEQ ID NO: 36
  Variant of ADP-beta-1,3-glycosyltransferase

SEQ ID NO: 281 - DNA, 1371 bp, Artificial Sequence
  Variant of ADP-beta-1,3-glycosyltransferase
atgccaaacactagtccaacaacggtacgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 282 - protein, 457 aa, Artificial Sequence; identical to SEQ ID NO: 36
  Variant of ADP-beta-1,3-glycosyltransferase

SEQ ID NO: 283 - DNA, 1371 bp, Artificial Sequence
  Variant of ADP-beta-1,3-glycosyltransferase
atgccgaatacgagcccaaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcagccggagtggcttcgcaacctgccgacccatggtccgggcgcgggtgcaagaatcccgcagattaacaaacacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgttcagcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 284 - protein, 457 aa, Artificial Sequence; identical to SEQ ID NO: 36
  Variant of ADP-beta-1,3-glycosyltransferase

SEQ ID NO: 285 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacaccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatctcgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 286 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRISSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 287 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 288 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 289 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgccgaccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 290 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPPTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 291 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatgccgagcagcagcggtctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 292 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRMPSSSGLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 293 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacgccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 294 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDAGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 295 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacgccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggggccgagcttcctgcttccgctgccgaagcattatagggcgtcgagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 296 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDAGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPGPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 297 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgccggccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 298 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPPAGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 299 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacaccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatcccgagcagcagcggtctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 300 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRIPSSSGLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 301 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacaccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 302 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 303 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggggccgagcttcctgcttccgctgccgaagcattatagggcgtcgagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 304 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPGPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 305 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacggccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 306 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTAGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 307 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacaccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 308 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 309 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacaccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatgtcgagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 310 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRMSSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 311 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgccggccggtccgggcgctggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatcccgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 312 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPPAGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRIPSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 313 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacaccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggggccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 314 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPGPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 315 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacaccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatgccgagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 316 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRMPSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 317 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacggccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 318 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTAGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 319 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacggccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatgccgagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 320 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTAGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRMPSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 321 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacaccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatgccgagcagcagcggtctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 322 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRMPSSSGLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 323 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgccgaccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatgccgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 324 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPPTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRMPSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 325 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacaccggtccgggcgctggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 326 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 327 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacgccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatgtcgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 328 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDAGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRMSSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 329 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgctggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 330 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 331 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagaagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 332 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQKPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 333 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggttctcgagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 334 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRFSSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 335 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgctggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatcccgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 336 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRIPSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 337 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacgccggtccgggcgctggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatgaagatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 338 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDAGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 339 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaaatctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtcgtgttatgcgtcaaaacgcgcgtaaattgaaggataagttggatcgaagcattgctcccggtggcagcagctacgagagcctggaacgcctgcagagctatattagcagcctg

SEQ ID NO: 340 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGRVMRQNARKLKDKLDRSIAPGGSSYESLERLQSYISSL

SEQ ID NO: 341 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacaccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggggccgagcttcctgcttccgctgccgaagcattataggatgtcgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 342 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPGPSFLLPLPKHYRMSSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 343 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcggtctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 344 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSGLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 345 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggacgccggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggctccgagcagcagcggtctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgatcaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 346 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPDAGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRAPSSSGLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 347 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgttggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggttctcgagcagcagcctgctggataccgatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 348 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRFSSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 349 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 350 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 351 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatgagtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 352 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDEFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 353 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtgttgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 354 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERVEIINAIRRVMVDPEGEVMRQNARKLKDKLDRSIAPGGSSYESLERLQSYISSL

SEQ ID NO: 355 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcgcgtacgagagcctggaacgcctgcagagctatattagcagcctg

SEQ ID NO: 356 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSAYESLERLQSYISSL

SEQ ID NO: 357 - DNA, 1371 bp, Artificial Sequence
  Variant of ADP-beta-1,3-glycosyltransferase
atgccgaacactttgccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 358 - protein, 457 aa, Artificial Sequence
  Variant of ADP-beta-1,3-glycosyltransferase
MPNTLPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 359 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatgcgtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 360 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDAFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 361 - DNA, 1371 bp, Artificial Sequence
  Variant of ADP-beta-1,3-glycosyltransferase
atgccgtctactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 362 - protein, 457 aa, Artificial Sequence
  Variant of ADP-beta-1,3-glycosyltransferase
MPSTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 363 - DNA, 1371 bp, Artificial Sequence
  Variant of ADP-beta-1,3-glycosyltransferase
atgccgaacactacgccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 364 - protein, 457 aa, Artificial Sequence
  Variant of ADP-beta-1,3-glycosyltransferase
MPNTTPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 365 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccatggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttattcgtcaaaacgcgcgtaaattgaaggataagttggatcgaagcattgctcccggtggcagcagctacgagagcctggaacgcctgcagagctatattagcagcctg

SEQ ID NO: 366 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVIRQNARKLKDKLDRSIAPGGSSYESLERLQSYISSL

SEQ ID NO: 367 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattatgagcctg

SEQ ID NO: 368 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYIMSL

SEQ ID NO: 369 - DNA, 1371 bp, Artificial Sequence
  Variant of ADP-beta-1,3-glycosyltransferase
atgccgaacactagtccagctaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 370 - protein, 457 aa, Artificial Sequence
  Variant of ADP-beta-1,3-glycosyltransferase
MPNTSPATVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 371 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctgatggctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 372 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLMASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 373 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtatggagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 374 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERMEIINAIRRVMVDPEGEVMRQNARKLKDKLDRSIAPGGSSYESLERLQSYISSL

SEQ ID NO: 375 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggattcgtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 376 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDSFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 377 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggtctggagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 378 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETIQREIPAPSFLLPLPKHYRASSSSLLDEDPSTAQWLDQQPPSSVLYVGFGSQSSVDPKDFLEIARGLVASKQSFLWLVRPGFVKGLEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 379 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggataattttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 380 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDNFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 381 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatattggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 382 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHIGVYLENGFERGEIINAIRRVMVDPEGEVMRQNARKLKDKLDRSIAPGGSSYESLERLQSYISSL

SEQ ID NO: 383 - DNA, 1371 bp, Artificial Sequence
  Variant of ADP-beta-1,3-glycosyltransferase
atgccgaacactgctccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 384 - protein, 457 aa, Artificial Sequence
  Variant of ADP-beta-1,3-glycosyltransferase
MPNTAPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 385 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgtctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 386 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHCLVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 387 - DNA, 1371 bp, Artificial Sequence
  Variant of ADP-beta-1,3-glycosyltransferase
atgccgaacactcatccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 388 - protein, 457 aa, Artificial Sequence
  Variant of ADP-beta-1,3-glycosyltransferase
MPNTHPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 389 - DNA, 1371 bp, Artificial Sequence
  Variant of ADP-beta-1,3-glycosyltransferase
atgccgaacactagtccacagaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 390 - protein, 457 aa, Artificial Sequence
  Variant of ADP-beta-1,3-glycosyltransferase
MPNTSPQTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 391 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaactctattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 392 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINSIRRVMVDPEGEVMRQNARKLKDKLDRSIAPGGSSYESLERLQSYISSL

SEQ ID NO: 393 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggtgagctatattagcagcctg

SEQ ID NO: 394 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 395 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattcggagcctg

SEQ ID NO: 396 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYIRSL

SEQ ID NO: 397 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggagagctatattagcagcctg

SEQ ID NO: 398 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLESYISSL

SEQ ID NO: 399 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgtgttccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 400 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADVFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 401 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcggcgagcagcagcctgctggatgaggatccgagcaccgcccaatggctggaccagcaaccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 402 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRAASSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 403 - DNA, 1371 bp, Artificial Sequence
  Variant of ADP-beta-1,3-glycosyltransferase
atgccaaacacaagccccaccaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcaaccgccgaagagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 404 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGAGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPKSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 405 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccacgggtccgggcgcgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 406 - protein, 457 aa, Artificial Sequence; identical to SEQ ID NO: 350
  Variant of ADP-beta-1,3-glycosyltransferase

SEQ ID NO: 407 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 408 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 409 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaagaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 410 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 411 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaagaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 412 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRISSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 413 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 414 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 415 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaagaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 416 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 417 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaagaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatgaagatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 418 - protein, 457 aa, Artificial Sequence; identical to SEQ ID NO: 288
  Variant of ADP-beta-1,3-glycosyltransferase

SEQ ID NO: 419 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccgctggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 420 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTAGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRISSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 421 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccgctggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatttcgagcagcagcctgctggatgaagatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 422 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTAGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRISSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 423 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccgctggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 424 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTAGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 425 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccgctggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaagaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 426 - protein, 457 aa, Artificial Sequence; identical to SEQ ID NO: 306
  Variant of ADP-beta-1,3-glycosyltransferase

SEQ ID NO: 427 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaagatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 428 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 429 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 430 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLQSYISSL

SEQ ID NO: 431 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccgctggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcgtcgagcagcagcctgctggatgaagatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 432 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTAGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 433 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaagaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatgaagatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 434 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 435 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggaagaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattataggatttcgagcagcagcctgctggatgaagatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 436 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPEEPVVGFPMLKVKDIRRAYSHWQEAKPILDKMVEETRASSGVIWNSFKELEESELETVQREIPAPSFLLPLPKHYRISSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 437 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccgctggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 438 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTAGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 439 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 440 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 441 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatagttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcgcgtacgagagcctggaacgcctgcagagctatattagcagcctg

SEQ ID NO: 442 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDSFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSAYESLERLQSYISSL

SEQ ID NO: 443 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcaatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatagttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 444 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDSFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 445 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggtggctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatatcggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggagagctatattagcagcctg

SEQ ID NO: 446 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHIGVYLENGFIRGEIINAIRRVMVDPEGEVMRQNARKLKDKLDRSIAPGGSSYESLERLESYISSL

SEQ ID NO: 447 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatgagtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagtagcctg

SEQ ID NO: 448 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDEFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 449 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 450 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 451 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgctctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatgggtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtgttgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 452 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRVEIINAIRRVMVDPEGEVMRQNARKLKDKLDRSIAPGGSSYESLERLQSYISSL

SEQ ID NO: 453 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatagttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcgcgtacgagagcctggaacgcctgcagagctatattatgagcctg

SEQ ID NO: 454 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDSFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSAYESLERLQSYIMSL

SEQ ID NO: 455 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatagttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 456 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDSFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 457 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggagagctatattagcagcctg

SEQ ID NO: 458 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLESYISSL

SEQ ID NO: 459 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgaaaagcgtgctgtacgttggctttggcagccagagctcggtggaccccaaagatttcctggagattgcgcgtggtctgatggctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 460 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETIQREIPAPSFLLPLPKHYRASSSSLLDTDPSTAQWLDQQPPKSVLYVGFGSQSSVDPKDFLEIARGLMASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 461 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctgatggctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggagagctatattagcagcctg

SEQ ID NO: 462 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLMASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLESYISSL

SEQ ID NO: 463 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaacccaaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 464 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEPKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 465 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagggaaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 466 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEGKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 467 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggtttcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 468 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVSSKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 469 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 470 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 471 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattagggcggtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 472 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRAVMVDPEGEVMRQNARKLKDKLDRSIAPGGSSYESLERLQSYISSL

SEQ ID NO: 473 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaatgcaaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 474 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPECKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 475 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgagcgcgttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 476 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDERVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 477 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggacgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaaacgaaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 478 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPETKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 479 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaatcgaaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 480 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPESKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 481 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggaaggtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 482 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRKVMVDPEGEVMRQNARKLKDKLDRSIAPGGSSYESLERLQSYISSL

SEQ ID NO: 483 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaacggagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 484 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEETELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 485 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattcagcccggtggcagcagctacgagagcctggaacgcctgcagagctatattagcagcctg

SEQ ID NO: 486 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIQPGGSSYESLERLQSYISSL

SEQ ID NO: 487 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtaccaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 488 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGTKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 489 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaccggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 490 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVTGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 491 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctgcaccgcctgcagagctatattagcagcctg

SEQ ID NO: 492 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLHRLQSYISSL

SEQ ID NO: 493 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgtctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcatttgcgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 494 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIICAIRRVMVDPEGEVMRQNARKLKDKLDRSIAPGGSSYESLERLQSYISSL

SEQ ID NO: 495 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggctgcatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 496 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGCMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 497 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgggaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 498 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGGKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 499 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcggtgggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 500 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIAVGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 501 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggacgttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 502 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEDVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 503 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttacctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 504 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGYLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 505 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaaagcctgcagagctatattagcagcctg

SEQ ID NO: 506 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLESLQSYISSL

SEQ ID NO: 507 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatagcccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 508 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHSPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 509 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacgcgaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 510 - protein, 457 aa, Artificial Sequence
  Variant of ADP-beta-1,3-glycosyltransferase
MPNTSPTTVRRRRVILFPVPFPGHANPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 511 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggagcgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 512 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRSVMVDPEGEVMRQNARKLKDKLDRSIAPGGSSYESLERLQSYISSL

SEQ ID NO: 513 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgagtccgttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 514 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDESVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 515 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccacgcgctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattacggcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 516 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHALVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIITAIRRVMVDPEGEVMRQNARKLKDKLDRSIAPGGSSYESLERLQSYISSL

SEQ ID NO: 517 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaagtaaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaaaggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 518 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPESKHRPDEPVVGFPMLKVKDIRRAYSHWQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 519 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 520 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 521 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaagtaaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaaaggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgaagcaaaacgcgcgtaaattgaaggataagttggatcgaagcattgctcccggtggcagcagctacgagagcctgcatcgcctggagagctatattatgagcctg

SEQ ID NO: 522 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPESKHRPDEPVVGFPMLKVKDIRRAYSHWQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMKQNARKLKDKLDRSIAPGGSSYESLHRLESYIMSL

SEQ ID NO: 523 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 524 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPEDKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 525 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatgaagatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaaaggttatgagtggattgagctgctgccggatgggtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctgcatcgcctggagagctatattagcagcctg

SEQ ID NO: 526 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPEDKHRPDEPVVGFPMLKVKDIRRAYSHIQEAKPILDKMVEETRASSGVIWNSFKELEESELETIQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLHRLESYISSL

SEQ ID NO: 527 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggagcgcctggagagctatattcgcagcctg

SEQ ID NO: 528 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLESYIRSL

SEQ ID NO: 529 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatgggtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgaagcaaaacgcgcgtaaattgaaggataagttggatcgaagcattgctcccggtggcagcagctacgagagcctggaacgcctgcagagctatattagcagcctg

SEQ ID NO: 530 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHWQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMKQNARKLKDKLDRSIAPGGSSYESLERLQSYISSL

SEQ ID NO: 531 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgagtggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgaagcaaaacgcgcgtaaattgaaggataagttggatcgaagcattgctcccggtggcagcagctacgagagcctggagcgcctggagagctatattatgagcctg

SEQ ID NO: 532 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPEDKHRPDEPVVGFPMLKVKDIRRAYSHWQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVSGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMKQNARKLKDKLDRSIAPGGSSYESLERLESYIMSL

SEQ ID NO: 533 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaaaggttatgagtggattgagctgctgccggatgagtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 534 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPEDKHRPDEPVVGFPMLKVKDIRRAYSHWQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDEFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 535 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatgggtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgaagcaaaacgcgcgtaaattgaaggataagttggatcgaagcattgctcccggtggcagcagctacgagagcctggagcgcctgcagagctatattagcagcctg

SEQ ID NO: 536 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMKQNARKLKDKLDRSIAPGGSSYESLERLQSYISSL

SEQ ID NO: 537 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaagtaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatgggtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 538 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPESKHRPDEPVVGFPMLKVKDIRRAYSHIQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 539 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaaaggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggagcgcctggagagctatattagcagcctg

SEQ ID NO: 540 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPEDKHRPDEPVVGFPMLKVKDIRRAYSHWQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLESYISSL

SEQ ID NO: 541 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgccaaaacgcgcgtaaattgaaggataagttggatcgaagcattgctcccggtggcagcagctacgagagcctgcatcgcctgcagagctatattagcagcctg

SEQ ID NO: 542 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPEDKHRPDEPVVGFPMLKVKDIRRAYSHWQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLHRLQSYISSL

SEQ ID NO: 543 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 544 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPEDKHRPDEPVVGFPMLKVKDIRRAYSHIQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 545 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtatgatggttgacccggaaggtgaggttatgcgtcaaaacgcgcgtaaattgaaggataagttggatcgaagcattgctcccggtggcagcagctacgagagcctggagcgcctggagagctatattatgagcctg

SEQ ID NO: 546 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRMMVDPEGEVMRQNARKLKDKLDRSIAPGGSSYESLERLESYIMSL

SEQ ID NO: 547 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgagtggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 548 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPEDKHRPDEPVVGFPMLKVKDIRRAYSHWQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVSGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 549 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatgaagatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatgggtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 550 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHWQEAKPILDKMVEETRASSGVIWNSFKELEESELETVQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 551 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatgaagatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattatgagcctg

SEQ ID NO: 552 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPEDKHRPDEPVVGFPMLKVKDIRRAYSHWQEAKPILDKMVEETRASSGVIWNSFKELEESELETIQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYIMSL

SEQ ID NO: 553 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgtcaaaacgcgcgtaaattgaaggataagttggatcgaagcattgctcccggtggcagcagctacgagagcctggagcgcctgcagagctatattcgcagcctg

SEQ ID NO: 554 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPEDKHRPDEPVVGFPMLKVKDIRRAYSHIQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYIRSL

SEQ ID NO: 555 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatgggtttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattactgcgattaggcgtgtgatggttgacccggaaggtgaggttatgcgtcaaaacgcgcgtaaattgaaggataagttggatcgaagcattgctcccggtggcagcagctacgagagcctggagcgcctggagagctatattagcagcctg

SEQ ID NO: 556 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIITAIRRVMVDPEGEVMRQNARKLKDKLDRSIAPGGSSYESLERLESYISSL

SEQ ID NO: 557 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaatatacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 558 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEYTRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 559 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctgatgaagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 560 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILMKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 561 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgtatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 562 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 563 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccgcggatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 564 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 565 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttgaggagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 566 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFEELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 567 - DNA, 1371 bp, Artificial Sequence
  Variant of ADP-beta-1,3-glycosyltransferase
atgccgaacactagtccaactacccttcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 568 - protein, 457 aa, Artificial Sequence
  Variant of ADP-beta-1,3-glycosyltransferase
MPNTSPTTLRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 569 - DNA, 1371 bp, Artificial Sequence
  Variant of ADP-beta-1,3-glycosyltransferase
atgccgaacactagtccaactaccgtccgtcgtcagcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 570 - protein, 457 aa, Artificial Sequence
  Variant of ADP-beta-1,3-glycosyltransferase
MPNTSPTTVRRQRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 571 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacgttgaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 572 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDVEGEVMRQNARKLKDKLDRSIAPGGSSYESLERLQSYISSL

SEQ ID NO: 573 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccgactgataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 574 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPTDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 575 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtgggctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 576 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKWAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 577 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtcgctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 578 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVSLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 579 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaagcggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 580 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQAVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 581 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagaatgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 582 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKNAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 583 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaatcgaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 584 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQESKPILDKMVEETRASSGVIWNSFKELEESELETVQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 585 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttaagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 586 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVKREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 587 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccagcagcctgtttaacttccactgcctggtgtgcctgccgaaatttttagagttgggctacctggatccggaagataaacatcgtccggatgaaccggtggtaggtttcccgatgctgaaggttaaagatatccgtcgcgcgtatagccactggcaagaagctaaaccaattctggataagatggttgaagaaacccgtgccagcagcggtgtgatttggaacagctttaaagagctggaggaaagcgagctggaaaccgttcagcgtgaaattccggcgccgagcttcctgcttccgctgccgaagcattatagggcttcgagcagcagcctgctggatacggatccggcgaccgcccaatggctggaccagcagccgccgagcagcgtgctgtacgttggctttggcagccagagctcggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctgcagagctatattagcagcctg

SEQ ID NO: 588 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTSSLFNFHCLVCLPKFLELGYLDPEDKHRPDEPVVGFPMLKVKDIRRAYSHWQEAKPILDKMVEETRASSGVIWNSFKELEESELETVQREIPAPSFLLPLPKHYRASSSSLLDTDPATAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 589 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggagcgcctggagagctatattcgcagcctg

SEQ ID NO: 590 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILMKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLESYIRSL

SEQ ID NO: 591 - DNA, 1371 bp, Artificial Sequence
  Variant of ADP-beta-1,3-glycosyltransferase
atgccgaacactagtccaactaccctgcgtcgtcagcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccagtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaatacacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaggatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagaacgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggagcgcctgcagagctatattcgcagcctg

SEQ ID NO: 592 - protein, 457 aa, Artificial Sequence
  Variant of ADP-beta-1,3-glycosyltransferase
MPNTSPTTLRRQRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEYTRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKNAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYIRSL

SEQ ID NO: 593 - DNA, 1371 bp, Artificial Sequence
  Variant of ADP-beta-1,3-glycosyltransferase
atgccgaacactagtccaactaccctgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaggatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 594 - protein, 457 aa, Artificial Sequence
  Variant of ADP-beta-1,3-glycosyltransferase
MPNTSPTTLRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILMKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 595 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttgaggagttgggctacctggatccggaaactaaacatcgtccggatgaaccggtggtaggtttcccgatgctgaaggttaaagatatccgtcgcgcgtatagccacattcaagaagcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaggatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacgttgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 596 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFEELGYLDPETKHRPDEPVVGFPMLKVKDIRRAYSHIQEAKPILMKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDVEGEVMRQNARKLKDKLDRSIAPGGSSYESLERLQSYISSL

SEQ ID NO: 597 - DNA, 1371 bp, Artificial Sequence
  Variant of ADP-beta-1,3-glycosyltransferase
atgccgaacactagtccaactaccctgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccagtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaagcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatgaggatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 598 - protein, 457 aa, Artificial Sequence
  Variant of ADP-beta-1,3-glycosyltransferase
MPNTSPTTLRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILMKMVEETRASSGVIWNSFKELEESELETIQREIPAPSFLLPLPKHYRASSSSLLDEDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 599 - DNA, 1371 bp, Artificial Sequence
  Variant of ADP-beta-1,3-glycosyltransferase
atgccgaacactagtccaactaccctgcgtcgtcagcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccagtggcggacagcctgaatctgaaacgtctggttctgcagaccgggagcctgtttaacttccactgcctggtgtgtctgccgaaatttgaggagttgggctacctggatccgactactaaacatcgtccggatgaaccggtggtaggtttcccgatgctgaaggttaaagatatccgtcgcgcgtatagccacattcaagaatcgaaaccaattctggataagatggttgaatacacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaggatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtgggctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 600 - protein, 457 aa, Artificial Sequence
  Variant of ADP-beta-1,3-glycosyltransferase
MPNTSPTTLRRQRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFEELGYLDPTTKHRPDEPVVGFPMLKVKDIRRAYSHIQESKPILDKMVEYTRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKWAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 601 - DNA, 1371 bp, Artificial Sequence
  Variant of ADP-beta-1,3-glycosyltransferase
atgccgaacactagtccaactaccctgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgagtctgccgaaatttgaggagttgggctacctggatccggagactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaggatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacgttgaaggtgaggttatgcgccaaaacgcgcgtaaattgaaggataagttggatcgaagcattgctcccggtggcagcagctacgagagcctggagcgcctgcagagctatattcgcagcctg

SEQ ID NO: 602 - protein, 457 aa, Artificial Sequence
  Variant of ADP-beta-1,3-glycosyltransferase
MPNTSPTTLRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVSLPKFEELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDVEGEVMRQNARKLKDKLDRSIAPGGSSYESLERLQSYIRSL

SEQ ID NO: 603 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggagactaaacatcgtccggatgaaccggtggtaggtttcccgatgctgaaggttaaagatatccgtcgcgcgtatagccacattcaagaatcgaaaccaattctggataagatggttgaatacacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatgaggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggagcgcctggagagctatattcgcagcctg

SEQ ID NO: 604 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILDKMVEYTRASSGVIWNSFKELEESELETIQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLESYIRSL

SEQ ID NO: 605 - DNA, 1371 bp, Artificial Sequence; identical to SEQ ID NO: 527
  Variant of ADP-beta-1,3-glycosyltransferase

SEQ ID NO: 606 - protein, 457 aa, Artificial Sequence; identical to SEQ ID NO: 528
  Variant of ADP-beta-1,3-glycosyltransferase

SEQ ID NO: 607 - DNA, 1371 bp, Artificial Sequence
  Variant of ADP-beta-1,3-glycosyltransferase
atgccgaacactagtccaactaccctgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccagtggcggacagcctgaatctgaaacgtctggttctgcagaccgggagcctgtttaacttccactgcctggtgtgcctgccgaaatttttagagttgggctacctggatccgactactaaacatcgtccggatgaaccggtggtaggtttcccgatgctgaaggttaaagatatccgtcgcgcgtatagccacattcaagaagctaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtgggctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggagcgcctggagagctatattcgcagcctg

SEQ ID NO: 608 - protein, 457 aa, Artificial Sequence
  Variant of ADP-beta-1,3-glycosyltransferase
MPNTSPTTLRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPTTKHRPDEPVVGFPMLKVKDIRRAYSHIQEAKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKWAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLESYIRSL

SEQ ID NO: 609 - DNA, 1371 bp, Artificial Sequence
  Variant of ADP-beta-1,3-glycosyltransferase
atgccgaacactagtccaactaccctgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaagcagtggcggacagcctgaatctgaaacgtctggttctgcagaccgggagcctgtttaacttccactgcctggtgagtctgccgaaatttctggagttgggctacctggatccggaaactaaacatcgtccggatgaaccggtggtaggtttcccgatgctgaaggttaaagatatccgtcgcgcgtatagccacattcaagaagcgaaaccaattctggataagatggttgaatacacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagaacgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 610 - protein, 457 aa, Artificial Sequence
  Variant of ADP-beta-1,3-glycosyltransferase
MPNTSPTTLRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQAVADSLNLKRLVLQTGSLFNFHCLVSLPKFLELGYLDPETKHRPDEPVVGFPMLKVKDIRRAYSHIQEAKPILDKMVEYTRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKNAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 611 - DNA, 1371 bp, Artificial Sequence
  Variant of ADP-beta-1,3-glycosyltransferase
atgccgaacactagtccaactaccctgcgtcgtcagcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccagtggcggacagcctgaatctgaaacgtctggttctgcagaccgggagcctgtttaacttccactgcctggtgtgtctgccgaaatttgaggagttgggctacctggatccggaaactaaacatcgtccggatgaaccggtggtaggtttcccgatgctgaaggttaaagatatccgtcgcgcgtatagccacattcaagaatcgaaaccaattctggataagatggttgaatacacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaggatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagaacgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 612 - protein, 457 aa, Artificial Sequence
  Variant of ADP-beta-1,3-glycosyltransferase
MPNTSPTTLRRQRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFEELGYLDPETKHRPDEPVVGFPMLKVKDIRRAYSHIQESKPILDKMVEYTRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKNAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 613 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgagtctgccgaaatttctggagttgggctacctggatccgactactaaacatcgtccggatgaaccggtggtaggtttcccgatgctgaaggttaaagatatccgtcgcgcgtatagccacattcaagaatcgaaaccaattctgatgaagatggttgaatacacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatgaggatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 614 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVSLPKFLELGYLDPTTKHRPDEPVVGFPMLKVKDIRRAYSHIQESKPILMKMVEYTRASSGVIWNSFKELEESELETIQREIPAPSFLLPLPKHYRASSSSLLDEDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 615 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccagtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 616 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 617 - DNA, 1371 bp, Artificial Sequence
  Variant of ADP-beta-1,3-glycosyltransferase
atgccgaacactagtccaactaccgtgcgtcgtcagcgtattattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccagtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaagcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagagcgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggagcgcctgcagagctatattcgcagcctg

SEQ ID NO: 618 - protein, 457 aa, Artificial Sequence
  Variant of ADP-beta-1,3-glycosyltransferase
MPNTSPTTVRRQRIILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQEAKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYIRSL

SEQ ID NO: 619 - DNA, 1371 bp, Artificial Sequence
  Variant of ADP-beta-1,3-glycosyltransferase
atgccgaacactagtccaactaccctgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttgaggagttgggctacctggatccggaaactaaacatcgtccggatgaaccggtggtaggtttcccgatgctgaaggttaaagatatccgtcgcgcgtatagccacattcaagaagcgaaaccaattctggataagatggttgaatacacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatgaggatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagagcgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggagcgcctggagagctatattcgcagcctg

SEQ ID NO: 620 - protein, 457 aa, Artificial Sequence
  Variant of ADP-beta-1,3-glycosyltransferase
MPNTSPTTLRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFEELGYLDPETKHRPDEPVVGFPMLKVKDIRRAYSHIQEAKPILDKMVEYTRASSGVIWNSFKELEESELETIQREIPAPSFLLPLPKHYRASSSSLLDEDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLESYIRSL

SEQ ID NO: 621 - DNA, 1371 bp, Artificial Sequence
  Variant of ADP-beta-1,3-glycosyltransferase
atgccgaacactagtccaactaccctgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaagcagtggcggacagcctgaatctgaaacgtctggttctgcagaccgggagcctgtttaacttccactgcctggtgtgcctgccgaaatttttagagttgggctacctggatccggagactaaacatcgtccggatgaaccggtggtaggtttcccgatgctgaaggttaaagatatccgtcgcgcgtatagccacattcaagaagctaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaggatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagaacgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggagcgcctggagagctatattagcagcctg

SEQ ID NO: 622 - protein, 457 aa, Artificial Sequence
  Variant of ADP-beta-1,3-glycosyltransferase
MPNTSPTTLRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQAVADSLNLKRLVLQTGSLFNFHCLVCLPKFLELGYLDPETKHRPDEPVVGFPMLKVKDIRRAYSHIQEAKPILMKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKNAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLESYISSL

SEQ ID NO: 623 - DNA, 1371 bp, Artificial Sequence
  Variant of ADP-beta-1,3-glycosyltransferase
atgccgaacactagtccaactaccctgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtgggctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 624 - protein, 457 aa, Artificial Sequence
  Variant of ADP-beta-1,3-glycosyltransferase
MPNTSPTTLRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKWAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 625 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 626 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 627 - DNA, 1371 bp, Artificial Sequence
  Variant of ADP-beta-1,3-glycosyltransferase
atgccgaacactagtccaactaccgtccgtcgtcagcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgagtctgccgaaatttctggagttgggctacctggatccggagactaaacatcgtccggatgaaccggtggtaggtttcccgatgctgaaggttaaagatatccgtcgcgcgtatagccacattcaagaagcgaaaccaattctggataagatggttgaatacacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgaccctgaaggtgaggttatgcgtcaaaacgcgcgtaaattgaaggataagttggatcgaagcattgctcccggtggcagcagctacgagagcctggagcgcctgcagagctatattcgcagcctg

SEQ ID NO: 628 - protein, 457 aa, Artificial Sequence
  Variant of ADP-beta-1,3-glycosyltransferase
MPNTSPTTVRRQRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVSLPKFLELGYLDPETKHRPDEPVVGFPMLKVKDIRRAYSHIQEAKPILDKMVEYTRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYIRSL

SEQ ID NO: 629 - DNA, 1371 bp, Artificial Sequence
  Variant of ADP-beta-1,3-glycosyltransferase
atgccgaacactagtccaactaccctgcgtcgtcagcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccagtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctggataagatggttgaatacacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaggatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtgggctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggagcgcctggagagctatattcgcagcctg

SEQ ID NO: 630 - protein, 457 aa, Artificial Sequence
  Variant of ADP-beta-1,3-glycosyltransferase
MPNTSPTTLRRQRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQESKPILDKMVEYTRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKWAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLESYIRSL

SEQ ID NO: 631 - DNA, 1371 bp, Artificial Sequence
  Variant of ADP-beta-1,3-glycosyltransferase
atgccgaacactagtccaactaccctgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgagtctgccgaaatttctggagttgggctacctggatccgactactaaacatcgtccggatgaaccggtggtaggtttcccgatgctgaaggttaaagatatccgtcgcgcgtatagccacattcaagaagcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagaacgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 632 - protein, 457 aa, Artificial Sequence
  Variant of ADP-beta-1,3-glycosyltransferase
MPNTSPTTLRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVSLPKFLELGYLDPTTKHRPDEPVVGFPMLKVKDIRRAYSHIQEAKPILMKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKNAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 633 - DNA, 1371 bp, Artificial Sequence
  Variant of ADP-beta-1,3-glycosyltransferase
atgccgaacactagtccaactaccgtgcgtcgtcagcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaagcagtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaagcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtgggctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgacgttgaaggtgaggttatgcgtcaaaacgcgcgtaaattgaaggataagttggatcgaagcattgctcccggtggcagcagctacgagagcctggagcgcctggagagctatattcgcagcctg

SEQ ID NO: 634 - protein, 457 aa, Artificial Sequence
  Variant of ADP-beta-1,3-glycosyltransferase
MPNTSPTTVRRQRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQAVADSLNLKRLVLQTGSLFNFHCLVCLPKFLELGYLDPETKHRPDEPVVGFPMLKVKDIRRAYSHIQEAKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKWAPQQEVLAHKAIGAFWTHGGWNGTMEAVCEGVPMIFSDFGLDQPLNARYMSEVLHVGVYLENGFIRGEIINAIRRVMVDVEGEVMRQNARKLKDKLDRSIAPGGSSYESLERLESYIRSL

SEQ ID NO: 635 - DNA, 1371 bp, Artificial Sequence
  Variant of ADP-beta-1,3-glycosyltransferase
atgccgaacactagtccaactaccctgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaagcagtggcggacagcctgaatctgaaacgtctggttctgcagaccgggagcctgtttaacttccactgcctggtgtgcctgccgaaatttttagagttgggctacctggatccggagactaaacatcgtccggatgaaccggtggtaggtttcccgatgctgaaggttaaagatatccgtcgcgcgtatagccacattcaagaagcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatgaggatccgagcaccgcccaatggctggaccagcagccgccgagcagcgtgctgtacgttggctttggcagccagagctcggtggaccccaaggatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagagcgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacgttgaaggtgaggttatgcgccaaaacgcgcgtaaattgaaggataagttggatcgaagcattgctcccggtggcagcagctacgagagcctggagcgcctggagagctatattagcagcctg

SEQ ID NO: 636 - protein, 457 aa, Artificial Sequence
  Variant of ADP-beta-1,3-glycosyltransferase
MPNTSPTTLRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQAVADSLNLKRLVLQTGSLFNFHCLVCLPKFLELGYLDPETKHRPDEPVVGFPMLKVKDIRRAYSHIQEAKPILMKMVEETRASSGVIWNSFKELEESELETIQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDVEGEVMRQNARKLKDKLDRSIAPGGSSYESLERLESYISSL

SEQ ID NO: 637 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaggatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 638 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQEAKPILMKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 639 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccagtggcggacagcctgaatctgaaacgtctggttctgcagaccgggagcctgtttaacttccactgcctggtgtgtctgccgaaatttgaggagttgggctacctggatccgactactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatgaggatccgagcaccgcccaatggctggaccagcagccgccgagcagcgtgctgtacgttggctttggcagccagagctcggtggaccccaaggatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagagcgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaacgcgattaggcgtgtgatggttgaccctgaaggtgaggttatgcgtcaaaacgcgcgtaaattgaaggataagttggatcgaagcattgctcccggtggcagcagctacgagagcctggagcgcctggagagctatattagcagcctg

SEQ ID NO: 640 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFEELGYLDPTTKHRPDEPVVGFPMLKVKDIRRAYSHIQESKPILMKMVEETRASSGVIWNSFKELEESELETIQREIPAPSFLLPLPKHYRASSSSLLDEDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLESYISSL

SEQ ID NO: 641 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctggctgatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 642 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLADTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 643 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgcaggataagttggatcgaagcattgctcccggtggcagcagctacgagagcctggaacgcctgcagagctatattagcagcctg

SEQ ID NO: 644 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLQDKLDRSIAPGGSSYESLERLQSYISSL

SEQ ID NO: 645 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtcttatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 646 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRLMVDPEGEVMRQNARKLKDKLDRSIAPGGSSYESLERLQSYISSL

SEQ ID NO: 647 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgcggtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 648 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVRSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 649 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggattgtccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 650 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDCPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 651 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 652 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 653 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggctactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 654 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPATGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 655 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgcagaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 656 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPQTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 657 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagcgcgaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 658 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSAKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 659 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatagtccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 660 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDSPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 661 - DNA, 1371 bp, Artificial Sequence
  Variant of ADP-beta-1,3-glycosyltransferase
atgccgaacactagtccaactaccgtccgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 662 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 663 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaatggggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 664 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKWGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 665 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacgttccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 666 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNVPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 667 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaactctcgtaaattgaaggataagttggatcgaagcattgctcccggtggcagcagctacgagagcctggaacgcctgcagagctatattagcagcctg

SEQ ID NO: 668 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNSRKLKDKLDRSIAPGGSSYESLERLQSYISSL

SEQ ID NO: 669 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttcggcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 670 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVRHVGVYLENGFIRGEIINAIRRVMVDPEGEVMRQNARKLKDKLDRSIAPGGSSYESLERLQSYISSL

SEQ ID NO: 671 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcggtgggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 672 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAVGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 673 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaccgagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 674 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKPSLYPHFQFRFILDNDPQPEWLRNLPTTGPGVGARIPQINKHGADEFRKELESAMRDTPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 675 - DNA, 1371 bp, Artificial Sequence
  Variant of ADP-beta-1,3-glycosyltransferase
atgccgaacactagtccaactaccgtccgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagcgcgatgcgggatgggccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgcctgccgaaatttttagagttgggctacctggatccggaaactaaacatcgtccggatgaaccggtggtaggtttcccgatgctgaaggttaaagatatccgtcgcgcgtatagccacattcaagaagctaaaccaattctggataagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatacggatccgagcaccgcccaatggctggaccagcagccgccgagcagcgtgctgtacgttggctttggcagccagagctcggtggaccccaaagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgacccggaaggtgaggttatgcgccaaaacgcgcgtaaattgaaggataagttggatcgaagcattgctcccggtggcagcagctacgagagcctggaacgcctgcagagctatattagcagcctg

SEQ ID NO: 676 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESAMRDGPSDEEVACVITDALWYFAQPVADSLNLKRLVLQTGSLFNFHCLVCLPKFLELGYLDPETKHRPDEPVVGFPMLKVKDIRRAYSHIQEAKPILDKMVEETRASSGVIWNSFKELEESELETIQREIPAPSFLLPLPKHYRASSSSLLDTDPSTAQWLDQQPPSSVLYVGFGSQSSVDPKDFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 677 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 678 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 679 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggcgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgcgctctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 680 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPATGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVRSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 681 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatacgccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaagataagttggatcgaagcattgctcccggtggcagcagctacgagagcctggaacgcctgcagagctatattagcagcctg

SEQ ID NO: 682 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 683 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatagcccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaagataagttggatcgaagcattgctcccggtggcagcagctacgagagcctggaacgcctgcagagctatattagcagcctg

SEQ ID NO: 684 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDSPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 685 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggcgactggtccgggcgtgggtgcaagaatcccgcagattaacaaacacggcgcggatgaattccgtaaagagctggaaagctgcatgcgggatagcccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaagataagttggatcgaagcattgctcccggtggcagcagctacgagagcctggaacgcctgcagagctatattagcagcctg

SEQ ID NO: 686 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPATGPGVGARIPQINKHGADEFRKELESCMRDSPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 687 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatacgccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 688 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 689 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgcgctctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttcgccatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 690 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVRSAPQQEVLAHKAIGAFWTHGGWNGTMEAVCEGVPMIFSDFGLDQPLNARYMSEVRHVGVYLENGFIRGEIINAIRRVMVDPEGEVMRQNARKLKDKLDRSIAPGGSSYESLERLQSYISSL

SEQ ID NO: 691 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatacgccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcttcaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaagataagttggatcgaagcattgctcccggtggcagcagctacgagagcctggaacgcctgcagagctatattagcagcctg

SEQ ID NO: 692 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 693 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 694 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 695 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatagcccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttcgccatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 696 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDSPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVRHVGVYLENGFIRGEIINAIRRVMVDPEGEVMRQNARKLKDKLDRSIAPGGSSYESLERLQSYISSL

SEQ ID NO: 697 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 698 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 699 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggcgactggtccgggcgtgggtgcaagaatcccgcagattaacaaacacggcgcggatgaattccgtaaagagctggaaagctgcatgcgggattgcccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 700 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPATGPGVGARIPQINKHGADEFRKELESCMRDCPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 701 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggcgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgcgctctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 702 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPATGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVRSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 703 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggcgactggtccgggcgtgggtgcaagaatcccgcagattaacaaacacggcgcggatgaattccgtaaagagctggaaagctgcatgcgggatacgccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 704 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPATGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 705 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 706 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 707 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatacgccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcttcaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgcgctctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtctgatggttgaccctgaaggtggggttatgcgccaaaacgcgcgtaaattgaaggataagttggatcgaagcattgctcccggtggcagcagctacgagagcctggaacgcctgcagagctatattagcagcctg

SEQ ID NO: 708 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVRSAPQQEVLAHKAIGAFWTHGGWNGTMEAVCEGVPMIFSDFGLDQPLNARYMSEVLHVGVYLENGFIRGEIINAIRRLMVDPEGGVMRQNARKLKDKLDRSIAPGGSSYESLERLQSYISSL

SEQ ID NO: 709 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatagcccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgcgctctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttcgccatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 710 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDSPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVRSAPQQEVLAHKAIGAFWTHGGWNGTMEAVCEGVPMIFSDFGLDQPLNARYMSEVRHVGVYLENGFIRGEIINAIRRVMVDPEGEVMRQNARKLKDKLDRSIAPGGSSYESLERLQSYISSL

SEQ ID NO: 711 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggcgactggtccgggcgtgggtgcaagaatcccgcagattaacaaacacggcgcggatgaattccgtaaagagctggaaagctgcatgcgggatacgccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaagataagttggatcgaagcattgctcccggtggcagcagctacgagagcctggaacgcctgcagagctatattagcagcctg

SEQ ID NO: 712 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPATGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 713 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggattgcccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttcgccatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 714 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDCPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVRHVGVYLENGFIRGEIINAIRRVMVDPEGEVMRQNARKLKDKLDRSIAPGGSSYESLERLQSYISSL

SEQ ID NO: 715 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccggcgactggtccgggcgtgggtgcaagaatcccgcagattaacaaacacggcgcggatgaattccgtaaagagctggaaagctgcatgcgggatagcccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctggcagatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 716 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPATGPGVGARIPQINKHGADEFRKELESCMRDSPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLADTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 717 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcaattccagtttcgttttatcttggacaacgatccgcaaccggagtggttacgcaacctgccggcgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtctgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 718 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPQFQFRFILDNDPQPEWLRNLPATGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRLMVDPEGEVMRQNARKLKDKLDRSIAPGGSSYESLERLQSYISSL

SEQ ID NO: 719 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 720 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 721 - DNA, 1371 bp, Artificial Sequence
  Variant of ADP-beta-1,3-glycosyltransferase
atgccgaacactaatccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 722 - protein, 457 aa, Artificial Sequence
  Variant of ADP-beta-1,3-glycosyltransferase
MPNTNPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 723 - DNA, 1371 bp, Artificial Sequence
  Variant of ADP-beta-1,3-glycosyltransferase
atgccgaacactatgccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 724 - protein, 457 aa, Artificial Sequence
  Variant of ADP-beta-1,3-glycosyltransferase
MPNTMPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 725 - DNA, 1371 bp, Artificial Sequence
  Variant of ADP-beta-1,3-glycosyltransferase
atgccgaacactttgccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 726 - protein, 457 aa, Artificial Sequence
  Variant of ADP-beta-1,3-glycosyltransferase
MPNTLPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 727 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgtttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 728 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVVCVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 729 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcgttggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 730 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 731 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 732 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSTSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 733 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgatggtgaggttatgcgccaaaacgcgcgtaaattgaaggataagttggatcgaagcattgctcccggtggcagcagctacgagagcctggaacgcctgcagagctatattagcagcctg

SEQ ID NO: 734 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPDGEVMRQNARKLKDKLDRSIAPGGSSYESLERLQSYISSL

SEQ ID NO: 735 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtcgggagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 736 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRRELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 737 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagtttcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 738 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVSCVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 739 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccggtgattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 740 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 741 - DNA, 1371 bp, Artificial Sequence
  Variant of ADP-beta-1,3-glycosyltransferase
atgccgaacactagtccaactaccgtgcgtcgtcgtcgtttgattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 742 - protein, 457 aa, Artificial Sequence
  Variant of ADP-beta-1,3-glycosyltransferase
MPNTSPTTVRRRRLILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 743 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggattcgttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 744 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADSFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 745 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatctgttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 746 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADLFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 747 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgagcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 748 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVEPEGEVMRQNARKLKDKLDRSIAPGGSSYESLERLQSYISSL

SEQ ID NO: 749 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcggtagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 750 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSGSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 751 - DNA, 1371 bp, Artificial Sequence
  Variant of ADP-beta-1,3-glycosyltransferase
atgccgaacactagtccacttaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 752 - protein, 457 aa, Artificial Sequence
  Variant of ADP-beta-1,3-glycosyltransferase
MPNTSPLTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 753 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatattaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 754 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNIKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 755 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcgtgagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 756 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSVSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 757 - DNA, 1371 bp, Artificial Sequence
  Variant of ADP-beta-1,3-glycosyltransferase
atgccgaacactcagccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 758 - protein, 457 aa, Artificial Sequence
  Variant of ADP-beta-1,3-glycosyltransferase
MPNTQPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 759 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgcggttatgcgccaaaacgcgcgtaaattgaaggataagttggatcgaagcattgctcccggtggcagcagctacgagagcctggaacgcctgcagagctatattagcagcctg

SEQ ID NO: 760 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGAVMRQNARKLKDKLDRSIAPGGSSYESLERLQSYISSL

SEQ ID NO: 761 - DNA, 1371 bp, Artificial Sequence
  Variant of ADP-beta-1,3-glycosyltransferase
atgccgaacactagtccaactaccgtgcgtcgtcgtcgtgttattctgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttgtgttggacaacgatccgcaaccggagtggttacgcaacctgccgaccactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagctttaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcgattaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 762 - protein, 457 aa, Artificial Sequence
  Variant of ADP-beta-1,3-glycosyltransferase
MPNTSPTTVRRRRVILFPVPFPGHLNPMLQLANVLYRRGFEITILHTNFNAPKTSLYPHFQFRFVLDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSFKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAIRRVMVDPEGEVMRQNARKLKDKLDRSIAPGGSSYESLERLQSYISSL

SEQ ID NO: 763 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagtagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgacggtgaggttatgcgccaaaacgcgcgtaaattgaaggataagttggatcgaagcattgctcccggtggcagcagctacgagagcctggaacgcctgcagagctatattagcagcctg

SEQ ID NO: 764 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPDGEVMRQNARKLKDKLDRSIAPGGSSYESLERLQSYISSL

SEQ ID NO: 765 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaggagctggaaagctgcatgcgggatactccgagtgacgaggaagttagttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtattcgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagtagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 766 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVSCVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 767 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaggagctggaaatctgcatgcgggatactccgagtgacgaggaagttgcttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtattcgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 768 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELEICMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSTSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 769 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcaaattaacaaacacggcgcggatgaattccgtaaagagctggaaagctgcatgcgggatactccgagtgacgaggaagttagttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgacggtgaggttatgcgccaaaacgcgcgtaaattgaaggataagttggatcgaagcattgctcccggtggcagcagctacgagagcctggaacgcctgcagagctatattagcagcctg

SEQ ID NO: 770 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVSCVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSSSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPDGEVMRQNARKLKDKLDRSIAPGGSSYESLERLQSYISSL

SEQ ID NO: 771 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcaaattaacaaacacggcgcggatgaattccgtaaggagctggaaagctgcatgcgggatactccgagtgacgaggaagttgcttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 772 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 773 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgtttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 774 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVVCVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 775 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 776 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 777 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgcttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 778 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSTSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 779 - DNA, 1371 bp, Artificial Sequence
  Variant of ADP-beta-1,3-glycosyltransferase
atgccgaacactagtccaaccaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatctgttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 780 - protein, 457 aa, Artificial Sequence
  Variant of ADP-beta-1,3-glycosyltransferase
MPNTSPTTVRRRRLIMFPVPFPGHLNPMLQLANVLYRRGFEITILHTNFNAPKTSLYPHFQFRFILDNDPQPEWLRNLPTTGPGVGARIPQINKHGADLFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 781 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgtttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 782 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVVCVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSTSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 783 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcaaattaacaaacacggcgcggatgaattccgtaaggagctggaaagctgcatgcgggatactccgagtgacgaggaagttgtttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtattcgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 784 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVVCVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSTSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 785 - DNA, 1371 bp, Artificial Sequence
  Variant of ADP-beta-1,3-glycosyltransferase
atgccgaacactagtccactgaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttgtcttggacaacgatccgcaaccggagtggttacgcaacctgccgacgactggtccgggcgtgggtgcaagaatcccgcagattaacaaacacggcgcggatctgttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgatcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 786 - protein, 457 aa, Artificial Sequence
  Variant of ADP-beta-1,3-glycosyltransferase
MPNTSPLTVRRRRLIMFPVPFPGHLNPMLQLANVLYRRGFEITILHTNFNAPKTSLYPHFQFRFVLDNDPQPEWLRNLPTTGPGVGARIPQINKHGADLFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 787 - DNA, 1371 bp, Artificial Sequence
  Variant of ADP-beta-1,3-glycosyltransferase
atgccgaacactagcccaactaccgtgcgtcgtcgccgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaggagctggaaagctgcatgcgggatactccgagtgacgaggaagttgtttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagtagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 788 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVVCVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSSSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 789 - DNA, 1371 bp, Artificial Sequence
  Variant of ADP-beta-1,3-glycosyltransferase
atgccgaacactagtccaactaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatctgttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcggcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 790 - protein, 457 aa, Artificial Sequence
  Variant of ADP-beta-1,3-glycosyltransferase
MPNTSPTTVRRRRLIMFPVPFPGHLNPMLQLANVLYRRGFEITILHTNFNAPKTSLYPHFQFRFILDNDPQPEWLRNLPTTGPGVGARIPQINKHGADLFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSGSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 791 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 792 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSTSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 793 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcaaattaacaaacacggcgcggatgaattccgtaaagagctggaaagctgcatgcgggatactccgagtgacgaggaagttgtttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgacggtgaggttatgcgccaaaacgcgcgtaaattgaaggataagttggatcgaagcattgctcccggtggcagcagctacgagagcctggaacgcctgcagagctatattagcagcctg

SEQ ID NO: 794 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVVCVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPDGEVMRQNARKLKDKLDRSIAPGGSSYESLERLQSYISSL

SEQ ID NO: 795 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcaaattaacaaacacggcgcggatgaattccgtcgcgagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtattcgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgacggtgaggttatgcgccaaaacgcgcgtaaattgaaggataagttggatcgaagcattgctcccggtggcagcagctacgagagcctggaacgcctgcagagctatattagcagcctg

SEQ ID NO: 796 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPQINKHGADEFRRELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPDGEVMRQNARKLKDKLDRSIAPGGSSYESLERLQSYISSL

SEQ ID NO: 797 - DNA, 1371 bp, Artificial Sequence
  Variant of ADP-beta-1,3-glycosyltransferase
atgccgaacactagtccaaccaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgatcctgaaggtgaggttatgcgccaaaacgcgcgtaaattgaaggataagttggatcgaagcattgctcccggtggcagcagctacgagagcctggaacgcctgcagagctatattcgcagcctg

SEQ ID NO: 798 - protein, 457 aa, Artificial Sequence
  Variant of ADP-beta-1,3-glycosyltransferase
MPNTSPTTVRRRRLIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYIRSL

SEQ ID NO: 799 - DNA, 1371 bp, Artificial Sequence
  Variant of ADP-beta-1,3-glycosyltransferase
atgccgaacactagtccaaccaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatagtttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgagcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 800 - protein, 457 aa, Artificial Sequence
  Variant of ADP-beta-1,3-glycosyltransferase
MPNTSPTTVRRRRLIMFPVPFPGHLNPMLQLANVLYRRGFEITILHTNFNAPKTSLYPHFQFRFILDNDPQPEWLRNLPTTGPGVGARIPQINKHGADSFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVEPEGEVMRQNARKLKDKLDRSIAPGGSSYESLERLQSYISSL

SEQ ID NO: 801 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcaaattaacaaacacggcgcggatgaattccgtaaggagctggaaagctgcatgcgggatactccgagtgacgaggaagttagttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtattcgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 802 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVSCVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 803 - DNA, 1371 bp, Artificial Sequence
  Variant of ADP-beta-1,3-glycosyltransferase
atgccgaacactagtccaaccaccgtgcgtcgtcgtcgtctgattatgtttccagttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggaaccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 804 - protein, 457 aa, Artificial Sequence
  Variant of ADP-beta-1,3-glycosyltransferase
MPNTSPTTVRRRRLIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLEPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 805 - DNA, 1371 bp, Artificial Sequence
  Variant of ADP-beta-1,3-glycosyltransferase
atgccgaacactctgccaaccaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatctgttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgatcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 806 - protein, 457 aa, Artificial Sequence
  Variant of ADP-beta-1,3-glycosyltransferase
MPNTLPTTVRRRRLIMFPVPFPGHLNPMLQLANVLYRRGFEITILHTNFNAPKTSLYPHFQFRFILDNDPQPEWLRNLPTTGPGVGARIPQINKHGADLFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 807 - DNA, 1371 bp, Artificial Sequence
  Variant of ADP-beta-1,3-glycosyltransferase
atgccgaacactagtccaaccaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatctgttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcggcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgagcctgaaggtgaggttatgcgccaaaacgcgcgtaaattgaaggataagttggatcgaagcattgctcccggtggcagcagctacgagagcctggaacgcctgcagagctatattcgcagcctg

SEQ ID NO: 808 - protein, 457 aa, Artificial Sequence
  Variant of ADP-beta-1,3-glycosyltransferase
MPNTSPTTVRRRRLIMFPVPFPGHLNPMLQLANVLYRRGFEITILHTNFNAPKTSLYPHFQFRFILDNDPQPEWLRNLPTTGPGVGARIPQINKHGADLFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSGSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVEPEGEVMRQNARKLKDKLDRSIAPGGSSYESLERLQSYIRSL

SEQ ID NO: 809 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgtttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtattcgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagtagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 810 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVVCVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 811 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgtttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgacggtgaggttatgcgccaaaacgcgcgtaaattgaaggataagttggatcgaagcattgctcccggtggcagcagctacgagagcctggaacgcctgcagagctatattagcagcctg

SEQ ID NO: 812 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVVCVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPDGEVMRQNARKLKDKLDRSIAPGGSSYESLERLQSYISSL

SEQ ID NO: 813 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtcgcgagctggaaagctgcatgcgggatactccgagtgacgaggaagttgcttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtattcgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgacggtgaggttatgcgccaaaacgcgcgtaaattgaaggataagttggatcgaagcattgctcccggtggcagcagctacgagagcctggaacgcctgcagagctatattagcagcctg

SEQ ID NO: 814 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRRELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSTSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPDGEVMRQNARKLKDKLDRSIAPGGSSYESLERLQSYISSL

SEQ ID NO: 815 - DNA, 1371 bp, Artificial Sequence
  Variant of ADP-beta-1,3-glycosyltransferase
atgccgaacactagtccaactaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatctgttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgagcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 816 - protein, 457 aa, Artificial Sequence
  Variant of ADP-beta-1,3-glycosyltransferase
MPNTSPTTVRRRRLIMFPVPFPGHLNPMLQLANVLYRRGFEITILHTNFNAPKTSLYPHFQFRFILDNDPQPEWLRNLPTTGPGVGARIPQINKHGADLFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVEPEGEVMRQNARKLKDKLDRSIAPGGSSYESLERLQSYISSL

SEQ ID NO: 817 - DNA, 1371 bp, Artificial Sequence
  Variant of ADP-beta-1,3-glycosyltransferase
atgccgaacactagtccaaccaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcggcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgatcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 818 - protein, 457 aa, Artificial Sequence
  Variant of ADP-beta-1,3-glycosyltransferase
MPNTSPTTVRRRRLIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSGSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 819 - DNA, 1371 bp, Artificial Sequence
  Variant of ADP-beta-1,3-glycosyltransferase
atgccgaacactagtccaaccaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgatcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 820 - protein, 457 aa, Artificial Sequence
  Variant of ADP-beta-1,3-glycosyltransferase
MPNTSPTTVRRRRLIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 821 - DNA, 1371 bp, Artificial Sequence
  Variant of ADP-beta-1,3-glycosyltransferase
atgccgaacactagtccaaccaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttgtcttggacaacgatccgcaaccggagtggttacgcaacctgccgacgactggtccgggcgtgggtgcaagaatcccgcagattaacaaacacggcgcggatctgttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgagcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 822 - protein, 457 aa, Artificial Sequence
  Variant of ADP-beta-1,3-glycosyltransferase
MPNTSPTTVRRRRLIMFPVPFPGHLNPMLQLANVLYRRGFEITILHTNFNAPKTSLYPHFQFRFVLDNDPQPEWLRNLPTTGPGVGARIPQINKHGADLFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVEPEGEVMRQNARKLKDKLDRSIAPGGSSYESLERLQSYISSL

SEQ ID NO: 823 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttagttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtattcgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgacggtgaggttatgcgccaaaacgcgcgtaaattgaaggataagttggatcgaagcattgctcccggtggcagcagctacgagagcctggaacgcctgcagagctatattagcagcctg

SEQ ID NO: 824 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVSCVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSTSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPDGEVMRQNARKLKDKLDRSIAPGGSSYESLERLQSYISSL

SEQ ID NO: 825 - DNA, 1371 bp, Artificial Sequence
  Variant of ADP-beta-1,3-glycosyltransferase
atgccgaacactagtccactgaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatagtttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgagcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 826 - protein, 457 aa, Artificial Sequence
  Variant of ADP-beta-1,3-glycosyltransferase
MPNTSPLTVRRRRLIMFPVPFPGHLNPMLQLANVLYRRGFEITILHTNFNAPKTSLYPHFQFRFILDNDPQPEWLRNLPTTGPGVGARIPQINKHGADSFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVEPEGEVMRQNARKLKDKLDRSIAPGGSSYESLERLQSYISSL

SEQ ID NO: 827 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttagttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgacggtgaggttatgcgccaaaacgcgcgtaaattgaaggataagttggatcgaagcattgctcccggtggcagcagctacgagagcctggaacgcctgcagagctatattagcagcctg

SEQ ID NO: 828 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVSCVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSTSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPDGEVMRQNARKLKDKLDRSIAPGGSSYESLERLQSYISSL

SEQ ID NO: 829 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtcgcgagctggaaagctgcatgcgggatactccgagtgacgaggaagttgtttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtattcgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 830 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRRELESCMRDTPSDEEVVCVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 831 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgtttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagtagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 832 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVVCVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 833 - DNA, 1371 bp, Artificial Sequence
  Variant of ADP-beta-1,3-glycosyltransferase
atgccgaacactagcccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtcgcgagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagtagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 834 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPVINKHGADEFRRELESCMRDTPSDEEVACVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 835 - DNA, 1371 bp, Artificial Sequence
  Variant of ADP-beta-1,3-glycosyltransferase
atgccgaacactagtccaactaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatctgttccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcggcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgagcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 836 - protein, 457 aa, Artificial Sequence
  Variant of ADP-beta-1,3-glycosyltransferase
MPNTSPTTVRRRRLIMFPVPFPGHLNPMLQLANVLYRRGFEITILHTNFNAPKTSLYPHFQFRFILDNDPQPEWLRNLPTTGPGVGARIPQINKHGADLFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSGSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVEPEGEVMRQNARKLKDKLDRSIAPGGSSYESLERLQSYISSL

SEQ ID NO: 837 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 838 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 839 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcaaattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 840 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 841 - DNA, 1371 bp, Artificial Sequence
  Variant of ADP-beta-1,3-glycosyltransferase
atgccgaacactagtccactgaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgatcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 842 - protein, 457 aa, Artificial Sequence
  Variant of ADP-beta-1,3-glycosyltransferase
MPNTSPLTVRRRRLIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 843 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 844 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSTSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 845 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtattcgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgagggtgaggttatgcgccaaaacgcgcgtaaattgaaggataagttggatcgaagcattgctcccggtggcagcagctacgagagcctggaacgcctgcagagctatattagcagcctg

SEQ ID NO: 846 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSTSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 847 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgacggtgaggttatgcgccaaaacgcgcgtaaattgaaggataagttggatcgaagcattgctcccggtggcagcagctacgagagcctggaacgcctgcagagctatattagcagcctg

SEQ ID NO: 848 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPDGEVMRQNARKLKDKLDRSIAPGGSSYESLERLQSYISSL

SEQ ID NO: 849 - DNA, 1371 bp, Artificial Sequence
  Variant of ADP-beta-1,3-glycosyltransferase
atgccgaacactagcccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaatcaacaaacacggcgcggatgaattccgtaaagagctggaaagctgcatgcgggatactccgagtgacgaggaagttgtttgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatccgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgacggtgaggttatgcgccaaaacgcgcgtaaattgaaggataagttggatcgaagcattgctcccggtggcagcagctacgagagcctggaacgcctgcagagctatattagcagcctg

SEQ ID NO: 850 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVVCVITDALWYFAQPVADSLNLKRLVLQTGSLFNFHCLVCLPKFLELGYLDPETKHRPDEPVVGFPMLKVKDIRRAYPHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPDGEVMRQNARKLKDKLDRSIAPGGSSYESLERLQSYISSL

SEQ ID NO: 851 - DNA, 1371 bp, Artificial Sequence
  Variant of ADP-beta-1,3-glycosyltransferase
atgccgaacactctgccaaccaccgtgcgtcgtcgtcgtctgattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcagattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagcagcctgctggatactgatccgagcaccgcccaatggctggaccagcagccgccgagcagcgtgctgtacgttggctttggcagccagagctcggtggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgagcctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 852 - protein, 457 aa, Artificial Sequence
  Variant of ADP-beta-1,3-glycosyltransferase
MPNTLPTTVRRRRLIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSVDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVEPEGEVMRQNARKLKDKLDRSIAPGGSSYESLERLQSYISSL

SEQ ID NO: 853 - DNA, 1371 bp, Artificial Sequence
  Variant of ADP-beta-1,3-glycosyltransferase
atgccgaacactagtccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccggtaattaacaaacacggcgcggatgaattccgtaaggagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtattcgcacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcagtagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 854 - protein, 457 aa, Artificial Sequence
  Variant of ADP-beta-1,3-glycosyltransferase
MPNTSPTTVRRRRVIMFPVPFPGHLNPMLQLANVLYRRGFEITILHTNFNAPKTSLYPHFQFRFILDNDPQPEWLRNLPTTGPGVGARIPVINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSSSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 855 - DNA, 1371 bp, Artificial Sequence
  Variant of ADP-beta-1,3-glycosyltransferase
atgccgaacactaacccaactaccgtgcgtcgtcgtcgtgttattatgtttccggttccgttcccgggccacttaaacccgatgctgcaactggcgaacgtgctgtaccgtagaggttttgaaatcaccattctgcacaccaacttcaacgccccgaaaaccagcctttatccgcacttccagtttcgttttatcttggacaacgatccgcaaccggagtggttacgcaacctgccgacgactggtccgggcgtgggtgcaagaatcccgcaaattaacaaacacggcgcggatgaattccgtaaagagctggaaagctgcatgcgggatactccgagtgacgaggaagttgcgtgcgtgattaccgatgcgctgtggtacttcgcgcaaccggtggcggacagcctgaatctgaaacgtctggttctgcagaccgggagcctgtttaacttccactgcctggtgtgtctgccgaaatttctggagttgggctacctggatccggaaactaaacatcgtccggatgaaccggtggtaggtttcccgatgctgaaggttaaagatatccgtcgcgcgtatagccacattcaagaatcgaaaccaattctgatgaagatggttgaagaaacccgtgccagcagcggtgtgatttggaacagcgctaaagagctggaggaaagcgagctggaaaccattcagcgtgaaattccggcgccgagcttcctgcttccgctgccgaagcattatagggcttcgagcactagcctgctggatactgatccgagcaccgcccaatggctggaccagcagccgccgagcagcgtgctgtacgttggctttggcagccagagctcgctggaccccgcagatttcctggagattgcgcgtggtctggttgcgagcaaacaaagctttctgtggctggttcgtccgggcttcgtgaagggttatgagtggattgagctgctgccggatggttttctgggtgaaaaaggtcgtatcgtgaagtctgctccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaggttctgcatgtgggcgtttatctggagaacggcttcatccgtggtgagatcattaatgcggttaggcgtgtgatggttgaccctgaaggtgaggttatgcgccaaaacgcgcgtaaattgaaggataagttggatcgaagcattgctcccggtggcagcagctacgagagcctggaacgcctgcagagctatattagcagcctg

SEQ ID NO: 856 - protein, 457 aa, Artificial Sequence
  Variant of ADP-beta-1,3-glycosyltransferase
MPNTNPTTVRRRRVIMFPVPFPGHLNPMLQLANVLYRRGFEITILHTNFNAPKTSLYPHFQFRFILDNDPQPEWLRNLPTTGPGVGARIPQINKHGADEFRKELESCMRDTPSDEEVACVITDALWYFAQPVADSLNLKRLVLQTGSLFNFHCLVCLPKFLELGYLDPETKHRPDEPVVGFPMLKVKDIRRAYSHIQESKPILMKMVEETRASSGVIWNSAKELEESELETIQREIPAPSFLLPLPKHYRASSTSLLDTDPSTAQWLDQQPPSSVLYVGFGSQSSLDPADFLEIARGLVASKQSFLWLVRPGFVKGYEWIELLPDGFLGEKGRIVKSAPQQEVLAHKAIGAFWTHGGWNGTMEAVCEGVPMIFSDFGLDQPLNARYMSEVLHVGVYLENGFIRGEIINAVRRVMVDPEGEVMRQNARKLKDKLDRSIAPGGSSYESLERLQSYISSL

SEQ ID NO: 857 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 858 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 859 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccattgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaactgctgagagcgagccgcgaggaggaaatgaacgcagcggcggaagaactgatacagctgtgtcgcaaccgcaacgcctacaag

SEQ ID NO: 860 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKLLRASREEEMNAAAEELIQLCRNRNAYK

SEQ ID NO: 861 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 862 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 863 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattatgaaggtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 864 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIMKVLKDVISGPTGEILRAKVRDISKRLRARREEEMNAAAEELIQLCRNRNAYK

SEQ ID NO: 865 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccattgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaactgctgagagcgagccgcgaggaggaaatgaacgcagcggcggaagaactgatacagctgtgtcgcaaccgcaacgcctacaag

SEQ ID NO: 866 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKLLRASREEEMNAAAEELIQLCRNRNAYK

SEQ ID NO: 867 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 868 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 869 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaactgctgagagcgcgccgcgaggaggaaatgaacgcagcggcggaagaactgatacagctgtgtcgcaaccgcaacgcctacaag

SEQ ID NO: 870 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKLLRARREEEMNAAAEELIQLCRNRNAYK

SEQ ID NO: 871 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagcaacagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaactgctgagagcgcgccgcgaggaggaaatgaacgcagcggcggaagaactgatacagctgtgtcgcaaccgcaacgcctacaag

SEQ ID NO: 872 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKLLRARREEEMNAAAEELIQLCRNRNAYK

SEQ ID NO: 873 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtctcgcttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 874 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVSLEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 875 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgccaaggtcctgaaagatgtgatttcgggcccgactggtgagatactgcgcgcgaaagtacgcgacattagcaaactgctgagagcgcgccgcgaggaggaaatgaacgcagcggcggaagaactgatacagctgtgtcgcaaccgcaacgcctacaag

SEQ ID NO: 876 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAKVLKDVISGPTGEILRAKVRDISKLLRARREEEMNAAAEELIQLCRNRNAYK

SEQ ID NO: 877 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattatgcaggtcctgaaagatgtgatttcgggcccgactggtgagatactgcgcgcgaaagtacgcgacattagcaaacgtctgagagcgagccgcgaggaggaaatgaacgcagcggcggaagaactgatacagctgtgtcgcaaccgcaacgcctacaag

SEQ ID NO: 878 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIMQVLKDVISGPTGEILRAKVRDISKRLRASREEEMNAAAEELIQLCRNRNAYK

SEQ ID NO: 879 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagattcttcaaaatcttaagccggacctggtcctttacgattttctgcagccgtgggcagaaaaagtcgcgcttgaacagggcatcccggctgttggtttgctaaccagtggtgcggcactgtttagctactttttcaacttcctgaagcgaccgggtcacgagtttccgtttcctgcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 880 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVGLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 881 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttggtttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaactgctgagagcgcgccgcgaggaggaaatgaacgcagcggcggaagaactgatacagctgtgtcgcaaccgcaacgcctacaag

SEQ ID NO: 882 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVGLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKLLRARREEEMNAAAEELIQLCRNRNAYK

SEQ ID NO: 883 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtctcgcttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaggtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 884 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVSLEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 885 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagattcttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattatgcaggtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 886 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIMQVLKDVISGPTGEILRAKVRDISKRLRARREEEMNAAAEELIQLCRNRNAYK

SEQ ID NO: 887 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagattcttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattatgaaggtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 888 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIMKVLKDVISGPTGEILRAKVRDISKRLRARREEEMNAAAEELIQLCRNRNAYK

SEQ ID NO: 889 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatcgagttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 890 - protein, 450 aa, Artificial Sequence
  Variant of ADP-beta-1,2-glycosyltransferase
MHHHHEGVSDQTLRVLMFPWLALGHVNPFLRIAKQLADRGFVIELVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 891 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctggggcgcaaccgcaacgcctacaag

SEQ ID NO: 892 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLGRNRNAYK

SEQ ID NO: 893 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtgcggagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 894 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGAEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 895 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 896 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 897 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgatctgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 898 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTDLTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 899 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtgaggagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 900 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGEEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 901 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 902 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 903 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccttaacgcctacaag

SEQ ID NO: 904 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNLNAYK

SEQ ID NO: 905 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaaacgggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 906 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALETGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 907 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattggtaaacgcctgagagcgagacgcgaggaggaaatgaacgcagcggcggaagaactgatacagctgtgtcgcaaccgcaacgcctacaag

SEQ ID NO: 908 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDIGKRLRARREEEMNAAAEELIQLCRNRNAYK

SEQ ID NO: 909 - DNA, 1350 bp, Artificial Sequence
  Variant of ADP-beta-1,2-glycosyltransferase
atgcacattcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 910 - protein, 450 aa, Artificial Sequence
  Variant of ADP-beta-1,2-glycosyltransferase
MHIHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 911 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcacggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 912 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRITEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 913 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcgctaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 914 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIAKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 915 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggttcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 916 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 917 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatgcagctgtgtcgcaaccgcaacgcctacaag

SEQ ID NO: 918 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELMQLCRNRNAYK

SEQ ID NO: 919 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttcgggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 920 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVRDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 921 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcagtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 922 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFSLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 923 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaatgtctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 924 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQCLKDVISGPTGEILRAKVRDISKRLRARREEEMNAAAEELIQLCRNRNAYK

SEQ ID NO: 925 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgggggcagcggcggaagaactgatacagctgtgtcgcaaccgcaacgcctacaag

SEQ ID NO: 926 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMGAAAEELIQLCRNRNAYK

SEQ ID NO: 927 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagaagtagacgcgaggaggaaatgaacgcagcggcggaagaactgatacagctgtgtcgcaaccgcaacgcctacaag

SEQ ID NO: 928 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRSRREEEMNAAAEELIQLCRNRNAYK

SEQ ID NO: 929 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcaggagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 930 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGQEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 931 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgtggcgcgaggaggaaatgaacgcagcggcggaagaactgatacagctgtgtcgcaaccgcaacgcctacaag

SEQ ID NO: 932 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRAWREEEMNAAAEELIQLCRNRNAYK

SEQ ID NO: 933 - DNA, 1350 bp, Artificial Sequence
  Variant of ADP-beta-1,2-glycosyltransferase
atgcacgttcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 934 - protein, 450 aa, Artificial Sequence
  Variant of ADP-beta-1,2-glycosyltransferase
MHVHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 935 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacgtgctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 936 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNVLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 937 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtatggttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 938 - protein, 450 aa, Artificial Sequence
  Variant of ADP-beta-1,2-glycosyltransferase
MHHHHEGVSDQTLRVLMFPWLALGHVNPFLRIAKQLADRGMVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 939 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaaccatctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 940 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNHLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 941 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcacgccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 942 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGTPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 943 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtctgttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 944 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVCYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 945 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcggcgcgcgaggaggaaatgaacgcagcggcggaagaactgatacagctgtgtcgcaaccgcaacgcctacaag

SEQ ID NO: 946 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRAAREEEMNAAAEELIQLCRNRNAYK

SEQ ID NO: 947 - DNA, 1350 bp, Artificial Sequence
  Variant of ADP-beta-1,2-glycosyltransferase
atgcaccatcatcatgaaggccgtagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 948 - protein, 450 aa, Artificial Sequence
  Variant of ADP-beta-1,2-glycosyltransferase
MHHHHEGRSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 949 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctggcgaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 950 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELANVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 951 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgccgtggaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 952 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVAVEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 953 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaaggtaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 954 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEGNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 955 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtgctccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 956 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGAPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 957 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgacgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 958 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPTFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 959 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtagtgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 960 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGSEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 961 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgcatcgcaaccgcaacgcctacaag

SEQ ID NO: 962 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLHRNRNAYK

SEQ ID NO: 963 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttatggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 964 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFMDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 965 - DNA, 1350 bp, Artificial Sequence
  Variant of ADP-beta-1,2-glycosyltransferase
atgcaccatcatcatgaaggcgtgagcgacttgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 966 - protein, 450 aa, Artificial Sequence
  Variant of ADP-beta-1,2-glycosyltransferase
MHHHHEGVSDLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 967 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagaagatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 968 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQKIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 969 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggaggtgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 970 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLEVSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 971 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattcgttggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 972 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIRWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 973 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgacggcagcggcggaagaactgatacagctgtgtcgcaaccgcaacgcctacaag

SEQ ID NO: 974 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMTAAAEELIQLCRNRNAYK

SEQ ID NO: 975 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacagtagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 976 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINSRLLVELGVAVEIVRDEDGRIHRGEIAQVLKDVISGPTGEILRAKVRDISKRLRARREEEMNAAAEELIQLCRNRNAYK

SEQ ID NO: 977 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtaatgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 978 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGNEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 979 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagcggatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 980 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQRIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 981 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgttgcagctgtgtcgcaaccgcaacgcctacaag

SEQ ID NO: 982 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELLQLCRNRNAYK

SEQ ID NO: 983 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagagtgaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 984 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKSEQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 985 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattgcgaaacgcctgagagcgagacgcgaggaggaaatgaacgcagcggcggaagaactgatacagctgtgtcgcaaccgcaacgcctacaag

SEQ ID NO: 986 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDIAKRLRARREEEMNAAAEELIQLCRNRNAYK

SEQ ID NO: 987 - DNA, 1350 bp, Artificial Sequence
  Variant of ADP-beta-1,2-glycosyltransferase
atgcaccatcatcatgaaggcgtgagcgaccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttctggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 988 - protein, 450 aa, Artificial Sequence
  Variant of ADP-beta-1,2-glycosyltransferase
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFLDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 989 - DNA, 1350 bp, Artificial Sequence
  Variant of ADP-beta-1,2-glycosyltransferase
atgcaccatcatcatgaaggcgtgagcgaccctaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccgttgctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 990 - protein, 450 aa, Artificial Sequence
  Variant of ADP-beta-1,2-glycosyltransferase
MHHHHEGVSDPTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPLLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 991 - DNA, 1350 bp, Artificial Sequence
  Variant of ADP-beta-1,2-glycosyltransferase
atgcacattcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatcgattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggatccaccgcggcgaaattgcccaagtcctgaaagatgtgatttcgggcccgactggtgagatactgcgcgcgaaagtacgcgacattggtaaacgcctgagagcgagacgcgaggaggaaatgaacgcagcggcggaagaactgatacagctgtgtcgcaaccgcaacgcctacaag

SEQ ID NO: 992 - protein, 450 aa, Artificial Sequence
  Variant of ADP-beta-1,2-glycosyltransferase
MHIHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDIGKRLRARREEEMNAAAEELIQLCRNRNAYK

SEQ ID NO: 993 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 994 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 995 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcgcaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatcgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattggtaaactgctgagagcgagacgcgaggaggaaatgaacgcagcggcggaagaactgatacagctgtgtcgcaaccgcaacgcctacaag

SEQ ID NO: 996 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIAKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDIGKLLRARREEEMNAAAEELIQLCRNRNAYK

SEQ ID NO: 997 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttatgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgagctgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatgtcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatgcagctgtgccgcaaccgtaacgcctacaag

SEQ ID NO: 998 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPGNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHVLNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELMQLCRNRNAYK

SEQ ID NO: 999 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttatgatctgctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatatcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatccagctgggccgcaacctgaacgcctacaag

SEQ ID NO: 1000 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDLLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLGRNLNAYK

SEQ ID NO: 1001 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcgcaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatcgattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1002 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIAKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1003 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1004 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1005 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggatccaccgcggcgaaattgcccaagtcctgaaagatgtgatttcgggcccgactggtgagatactgcgcgcgaaagtacgcgacattggtaaactgctgagagcgagacgcgaggaggaaatgaacgcagcggcggaagaactgatacagctgtgtcgcaaccgcaacgcctacaag

SEQ ID NO: 1006 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDIGKLLRARREEEMNAAAEELIQLCRNRNAYK

SEQ ID NO: 1007 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1008 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1009 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcgcaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaaacgggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgcgatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttcgtgaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1010 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIAKRIPEKYSNSIHLVELALPELPELPPHYHTTNGLPPHLNGTLHKALKMSAPNFSKILQNLKPDLVLYDFLVPWAEKVALETGIPAVPLLTSGAALFSYFFNFLKRPGHEFPFEAIRLSKREQDKMREMFGTEPTEEDFLAPQNAAIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVRDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1011 - DNA, 1350 bp, Artificial Sequence
  Variant of ADP-beta-1,2-glycosyltransferase
atgcaccatcatcatgaaggcgtgagcgaccagacccagagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttatgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgagctgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatgtcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatgcagctgtgccgcaaccgtaacgcctacaag

SEQ ID NO: 1012 - protein, 450 aa, Artificial Sequence
  Variant of ADP-beta-1,2-glycosyltransferase
MHHHHEGVSDQTQRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHVLNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELMQLCRNRNAYK

SEQ ID NO: 1013 - DNA, 1350 bp, Artificial Sequence
  Variant of ADP-beta-1,2-glycosyltransferase
atgcacattcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattggtaaacgcctgagagcgagacgcgaggaggaaatgaacgcagcggcggaagaactgatacagctgtgtcgcaaccgcaacgcctacaag

SEQ ID NO: 1014 - protein, 450 aa, Artificial Sequence
  Variant of ADP-beta-1,2-glycosyltransferase
MHIHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDIGKRLRARREEEMNAAAEELIQLCRNRNAYK

SEQ ID NO: 1015 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggatccaccgcggcgaaattgcccaagtcctgaaagatgtgatttcgggcccgactggtgagatactgcgcgcgaaagtacgcgacattagtaaactgctgagagcgagacgcgaggaggaaatgaacgcagcggcggaagaactgatacagctgtgtcgcaaccgcaacgcctacaag

SEQ ID NO: 1016 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKLLRARREEEMNAAAEELIQLCRNRNAYK

SEQ ID NO: 1017 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgcagagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatgtcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1018 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGAEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHVLNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1019 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcgcaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggatccaccgcggcgaaattgcccaagtcctgaaagatgtgatttcgggcccgactggtgagatactgcgcgcgaaagtacgcgacattggtaaactgctgagagcgagacgcgaggaggaaatgaacgcagcggcggaagaactgatacagctgtgtcgcaaccgcaacgcctacaag

SEQ ID NO: 1020 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIAKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDIGKLLRARREEEMNAAAEELIQLCRNRNAYK

SEQ ID NO: 1021 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgacctgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatgtcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatgcagctgtgccgcaacctgaacgcctacaag

SEQ ID NO: 1022 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPGNAGIMLMCTSRVIEAKYLDYCTDLTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHVLNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELMQLCRNLNAYK

SEQ ID NO: 1023 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcgcaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttcgtgaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattggtaaacgcctgagagcgagacgcgaggaggaaatgaacgcagcggcggaagaactgatacagctgtgtcgcaaccgcaacgcctacaag

SEQ ID NO: 1024 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIAKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVRDHLVPQAHILNHPSTGGFISHCGWNSVMESIDFGVPIIAMPMQWDQPINARLLVELGVAVEIVRDEDGRVHRGEIAQVLKDVISGPTGEILRAKVRDIGKRLRARREEEMNAAAEELIQLCRNRNAYK

SEQ ID NO: 1025 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttatgattttctggttccgtgggcagaaaaagtcgcgcttgaacagggcatcccggctgttccattgctaaccagtggtgcggcactgtttagctactttttcaacttcctgaagcgaccgggtgcagagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatatcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatccagctgtgccgcaacctgaacgcctacaag

SEQ ID NO: 1026 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGAEFPFEAIRLSKREQDKMREMFGTEPTEEDFLAPGNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNLNAYK

SEQ ID NO: 1027 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaaacgggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggatccaccgcggcgaaattgcccaagtcctgaaagatgtgatttcgggcccgactggtgagatactgcgcgcgaaagtacgcgacattagtaaacgcctgagagcgagacgcgaggaggaaatgaacgcagcggcggaagaactgatacagctgtgtcgcaaccgcaacgcctacaag

SEQ ID NO: 1028 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALETGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1029 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcgcaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagtaaacgcctgagagcgagacgcgaggaggaaatgaacgcagcggcggaagaactgatacagctgtgtcgcaaccgcaacgcctacaag

SEQ ID NO: 1030 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIAKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1031 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatccagctgggccgcaacctgaacgcctacaag

SEQ ID NO: 1032 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLGRNLNAYK

SEQ ID NO: 1033 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaacgcctgagagcgagacgcgaggaggaaatgaacgcagcggcggaagaactgatacagctgtgtcgcaaccgcaacgcctacaag

SEQ ID NO: 1034 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1035 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaacgcctgagagcgagacgcgaggaggaaatgaacgcagcggcggaagaactgatacagctgtgtcgcaaccgcaacgcctacaag

SEQ ID NO: 1036 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1037 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcagctgcatatcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1038 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQLHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1039 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcgcaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaaacgggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattggtaaacgcctgagagcgagacgcgaggaggaaatgaacgcagcggcggaagaactgatacagctgtgtcgcaaccgcaacgcctacaag

SEQ ID NO: 1040 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIAKRIPEKYSNSIHLVELALPELPELPPHYHTTNGLPPHLNGTLHKALKMSAPNFSKILQNLKPDLVLYDFLVPWAEKVALETGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDIGKRLRARREEEMNAAAEELIQLCRNRNAYK

SEQ ID NO: 1041 - DNA, 1350 bp, Artificial Sequence
  Variant of ADP-beta-1,2-glycosyltransferase
atgcacattcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccgcgatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttcgtgaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1042 - protein, 450 aa, Artificial Sequence
  Variant of ADP-beta-1,2-glycosyltransferase
MHIHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAAIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVRDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1043 - DNA, 1350 bp, Artificial Sequence
  Variant of ADP-beta-1,2-glycosyltransferase
atgcacattcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccgcgatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttcgtgaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1044 - protein, 450 aa, Artificial Sequence
  Variant of ADP-beta-1,2-glycosyltransferase
MHIHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAAIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVRDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1045 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattggtaaacgcctgagagcgagacgcgaggaggaaatgaacgcagcggcggaagaactgatacagctgtgtcgcaaccgcaacgcctacaag

SEQ ID NO: 1046 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDIGKRLRARREEEMNAAAEELIQLCRNRNAYK

SEQ ID NO: 1047 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttatgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatccagctgtgccgcaacctgaacgcctacaag

SEQ ID NO: 1048 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNLNAYK

SEQ ID NO: 1049 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatcgaattagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttatgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatatcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1050 - protein, 450 aa, Artificial Sequence
  Variant of ADP-beta-1,2-glycosyltransferase
MHHHHEGVSDQTLRVTMFPWLALGHVNPFLRIAKQLADRGFVIELVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPGNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1051 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttatgattttctggttccgtgggcagaaaaagtcgcgcttgaacagggcatcccggctgttccattgctaaccagtggtgcggcactgtttagctactttttcaacttcctgaagcgaccgggtgcagagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatgcagctgtgccgcaaccgtaacgcctacaag

SEQ ID NO: 1052 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGAEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELMQLCRNRNAYK

SEQ ID NO: 1053 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcgcaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaaacgggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttcgtgaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1054 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIAKRIPEKYSNSIHLVELALPELPELPPHYHTTNGLPPHLNGTLHKALKMSAPNFSKILQNLKPDLVLYDFLVPWAEKVALETGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVRDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1055 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttatgattttctggttccgtgggcagaaaaagtcgcgcttgaacagggcatcccggctgttccattgctaaccagtggtgcggcactgtttagctactttttcaacttcctgaagcgaccgggtgcagagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatatcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatccagctgggccgcaaccgtaacgcctacaag

SEQ ID NO: 1056 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGAEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLGRNRNAYK

SEQ ID NO: 1057 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttatgatctgctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1058 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDLLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1059 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatcgaattagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttatgattttctggttccgtgggcagaaaaagtcgcgcttgaacagggcatcccggctgttccattgctaaccagtggtgcggcactgtttagctactttttcaacttcctgaagcgaccgggtgcagagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatccagctgtgccgcaaccgtaacgcctacaag

SEQ ID NO: 1060 - protein, 450 aa, Artificial Sequence
  Variant of ADP-beta-1,2-glycosyltransferase
MHHHHEGVSDQTLRVTMFPWLALGHVNPFLRIAKQLADRGFVIELVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGAEFPFEAIRLSKREQDKMREMFGTEPTEEDFLAPGNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1061 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatcgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattggtaaactgctgagagcgagacgcgaggaggaaatgaacgcagcggcggaagaactgatacagctgtgtcgcaaccgcaacgcctacaag

SEQ ID NO: 1062 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDIGKLLRARREEEMNAAAEELIQLCRNRNAYK

SEQ ID NO: 1063 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcgcaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaaacgggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttcgtgaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaactgctgagagcgagacgcgaggaggaaatgaacgcagcggcggaagaactgatacagctgtgtcgcaaccgcaacgcctacaag

SEQ ID NO: 1064 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIAKRIPEKYSNSIHLVELALPELPELPPHYHTTNGLPPHLNGTLHKALKMSAPNFSKILQNLKPDLVLYDFLVPWAEKVALETGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVRDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKLLRARREEEMNAAAEELIQLCRNRNAYK

SEQ ID NO: 1065 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaaacgggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1066 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALETGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1067 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtctcgctaaacaactggccgatcgtggtttcgttatctatttagttagtaccgctattaacctcgaaagcatcgcaaagagaatcacggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttcgtgaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattggtaaacgcctgagagcgagacgcgaggaggaaatgaacgcagcggcggaagaactgatacagctgtgtcgcaaccgcaacgcctacaag

SEQ ID NO: 1068 - protein, 450 aa, Artificial Sequence
  Variant of ADP-beta-1,2-glycosyltransferase
MHHHHEGVSDQTLRVTMFPWLGLGHVNPFLRLAKQLADRGFVIYLVSTAINLESIAKRITEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVRDHLVPQAHILNHPSTGGFISHCGWNSVMESIDFGVPIIAMPMQWDQPINARLLVELGVAVEIVRDEDGRVHRGEIAQVLKDVISGPTGEILRAKVRDIGKRLRARREEEMNAAAEELIQLCRNRNAYK

SEQ ID NO: 1069 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttatgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgacctgaccaatgtaaaagttgttccggttggtccgccgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcagctgcatgtcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatccagctgtgccgcaaccgtaacgcctacaag

SEQ ID NO: 1070 - protein, 450 aa, Artificial Sequence
  Variant of ADP-beta-1,2-glycosyltransferase
MHHHHEGVSDQTLRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTDLTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQLHVLNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1071 - DNA, 1350 bp, Artificial Sequence
  Variant of ADP-beta-1,2-glycosyltransferase
atgcaccatcatcatgaaggcgtgagcgaccagacccagagagtaacgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatatcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatgcagctgggccgcaaccgtaacgcctacaag

SEQ ID NO: 1072 - protein, 450 aa, Artificial Sequence
  Variant of ADP-beta-1,2-glycosyltransferase
MHHHHEGVSDQTQRVTMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELMQLGRNRNAYK

SEQ ID NO: 1073 - DNA, 1350 bp, Artificial Sequence
  Variant of ADP-beta-1,2-glycosyltransferase
atgcaccaccatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcacggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggtctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattggtaaacgcctgagagcgagacgcgaggaggaaatgaacgcagcggcggaagaactgatacagctgtgtcgcaaccgcaacgcctacaag

SEQ ID NO: 1074 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRITEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDIGKRLRARREEEMNAAAEELIQLCRNRNAYK

SEQ ID NO: 1075 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatcgaattagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatgtcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1076 - protein, 450 aa, Artificial Sequence
  Variant of ADP-beta-1,2-glycosyltransferase
MHHHHEGVSDQTLRVTMFPWLALGHVNPFLRIAKQLADRGFVIELVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHVLNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1077 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgcgctgggtcatgttaacccgtttttgcgtatcgctaaacaactggccgatcgtggtttcgttatcgaattagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcagctgcatgtcctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1078 - protein, 450 aa, Artificial Sequence
  Variant of ADP-beta-1,2-glycosyltransferase
MHHHHEGVSDQTLRVTMFPWLALGHVNPFLRIAKQLADRGFVIELVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPGNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQLHVLNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 1079 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1080 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1081 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccatattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1082 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPYYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPSFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1083 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaacgcctgagagcgagacgcgaggaggaaatgaacgcagcggcggaagaactgatacagctgtgtcgcaaccgcaacgcctacaag

SEQ ID NO: 1084 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1085 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaactgctgagagcgagacgcgaggaggaaatgaacgcagcggcggaagaactgatacagctgtgtcgcaaccgcaacgcctacaag

SEQ ID NO: 1086 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKLLRARREEEMNAAAEELIQLCRNRNAYK

SEQ ID NO: 1087 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaactgctgagagcgagacgcgaggaggaaatgaacgcagcggcggaagaactgatacagctgtgtcgcaaccgcaacgcctacaag

SEQ ID NO: 1088 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPSFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKLLRARREEEMNAAAEELIQLCRNRNAYK

SEQ ID NO: 1089 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgtcgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaacgcctgagagcgagacgcgaggaggaaatgaacgcagcggcggaagaactgatacagctgtgtcgcaaccgcaacgcctacaag

SEQ ID NO: 1090 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPSFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1091 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatgttctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1092 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPSFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHVLNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1093 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1094 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1095 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaactgctgagagcgagacgcgaggaggaaatgaacgcagcggcggaagaactgatacagctgtgtcgcaaccgcaacgcctacaag

SEQ ID NO: 1096 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKLLRARREEEMNAAAEELIQLCRNRNAYK

SEQ ID NO: 1097 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatgttctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaacgcctgagagcgagacgcgaggaggaaatgaacgcagcggcggaagaactgatacagctgtgtcgcaaccgcaacgcctacaag

SEQ ID NO: 1098 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHVLNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1099 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgtcgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1100 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPSFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1101 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1102 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1103 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattggtaaactgctgagagcgagacgcgaggaggaaatgaacgcagcggcggaagaactgatacagctgtgtcgcaaccgcaacgcctacaag

SEQ ID NO: 1104 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDIGKLLRARREEEMNAAAEELIQLCRNRNAYK

SEQ ID NO: 1105 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1106 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1107 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatgttctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaactgctgagagcgagacgcgaggaggaaatgaacgcagcggcggaagaactgatacagctgtgtcgcaaccgcaacgcctacaag

SEQ ID NO: 1108 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHVLNHPSTGGFISHCGWNSVMESIDFGVPIIAMPMQWDQPINARLLVELGVAVEIVRDEDGRVHRGEIAQVLKDVISGPTGEILRAKVRDISKLLRARREEEMNAAAEELIQLCRNRNAYK

SEQ ID NO: 1109 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaactgctgagagcgagacgcgaggaggaaatgaacgcagcggcggaagaactgatacagctgtgtcgcaaccgcaacgcctacaag

SEQ ID NO: 1110 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKLLRARREEEMNAAAEELIQLCRNRNAYK

SEQ ID NO: 1111 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatgttctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1112 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHVLNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1113 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagtaaacgcctgagagcgagacgcgaggaggaaatgaacgcagcggcggaagaactgatacagctgtgtcgcaacctgaacgcctacaag

SEQ ID NO: 1114 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNLNAYK

SEQ ID NO: 1115 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagctgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1116 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELIDWLDTKPENSVVYVSFGSEYFLSCEDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1117 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcactcgcctgagagcgagacgcgaggaggaaatgaacgcagcggcggaagaactgatacagctgtgtcgcaaccgcaacgcctacaag

SEQ ID NO: 1118 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISTRLRARREEEMNAAAEELIQLCRNRNAYK

SEQ ID NO: 1119 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaacttatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1120 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLELIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1121 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcgctcgcctgagagcgagacgcgaggaggaaatgaacgcagcggcggaagaactgatacagctgtgtcgcaaccgcaacgcctacaag

SEQ ID NO: 1122 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1123 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcgtgcgcctgagagcgagacgcgaggaggaaatgaacgcagcggcggaagaactgatacagctgtgtcgcaaccgcaacgcctacaag

SEQ ID NO: 1124 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISVRLRARREEEMNAAAEELIQLCRNRNAYK

SEQ ID NO: 1125 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1126 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1127 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaacgggtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1128 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAERVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1129 - DNA, 1350 bp, Artificial Sequence
  Variant of ADP-beta-1,2-glycosyltransferase
atgcaccatcatcatgaaacggtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1130 - protein, 450 aa, Artificial Sequence
  Variant of ADP-beta-1,2-glycosyltransferase
MHHHHETVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1131 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacatctgcatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1132 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHLHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1133 - DNA, 1350 bp, Artificial Sequence
  Variant of ADP-beta-1,2-glycosyltransferase
atgcaccatcatcatgaaggcgtgcttgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1134 - protein, 450 aa, Artificial Sequence
  Variant of ADP-beta-1,2-glycosyltransferase
MHHHHEGVLDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1135 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1136 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1137 - DNA, 1350 bp, Artificial Sequence
  Variant of ADP-beta-1,2-glycosyltransferase
atgcaccatcatcatgaaggcgtgagcccgcagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagcggatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1138 - protein, 450 aa, Artificial Sequence
  Variant of ADP-beta-1,2-glycosyltransferase
MHHHHEGVSPQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1139 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccagagggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1140 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPEGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1141 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagctctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1142 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSSPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1143 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacccgtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1144 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHPFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1145 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgattcagggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1146 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVIQGPTGEILRAKVRDISKRLRARREEEMNAAAEELIQLCRNRNAYK

SEQ ID NO: 1147 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgtctctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1148 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELSLPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1149 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1150 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISKRLRARREEEMNAAAEELIQLCRNRNAYK

SEQ ID NO: 1151 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggggtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1152 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1153 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaagcgcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1154 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQALKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1155 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgattcatggcccgactggtgagatactgcgcgcgaaagtacgcgacattagcaaacgcctgagagcaagacgcgaggaggaaatgaacgcagcggcggaagaactgatacagctgtgtcgcaaccgcaacgcctacaag

SEQ ID NO: 1156 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVIHGPTGEILRAKVRDISKRLRARREEEMNAAAEELIQLCRNRNAYK

SEQ ID NO: 1157 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagctctgatacagctgtgtcgcaaccgcaacgcctacaag

SEQ ID NO: 1158 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEALIQLCRNRNAYK

SEQ ID NO: 1159 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgtctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1160 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1161 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaaactctgatacagctgtgtcgcaaccgcaacgcctacaag

SEQ ID NO: 1162 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAETLIQLCRNRNAYK

SEQ ID NO: 1163 - DNA, 1350 bp, Artificial Sequence
  Variant of ADP-beta-1,2-glycosyltransferase
atgcatcaccatcacgagggtgtaagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1164 - protein, 450 aa, Artificial Sequence; identical to SEQ ID NO: 994
  Variant of ADP-beta-1,2-glycosyltransferase

SEQ ID NO: 1165 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtcacgagtttccgtttgaggcaatccgcctgtcgaagcgagaacaggataagatgcgcgagatgtttggaacagagccgacggaagaagattttttagcacctcaaaatgccgggtatatgctgatgtgcacgagccgcgtaattgaggctaagtacctggactattgcaccgaactgaccaatgtaaaagttgttccggttggtccgccatttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgctcgtggaattaggcgtggcagtggagatcgtgcgtgatgaagatggccgggtccaccgcggcgaaattgcccaagtcctgaaagatgtgattatgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1166 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGHEFPFEAIRLSKREQDKMREMFGTEPTEEDFLAPQNAGYMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVIMGPTGEILRAKVRDISKRLRARREEEMNAAAEELIQLCRNRNAYK

SEQ ID NO: 1167 - DNA, 1350 bp, Artificial Sequence
  Variant of ADP-beta-1,2-glycosyltransferase
atgcaccatcatcatgaaggtgtgctggaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1168 - protein, 450 aa, Artificial Sequence
  Variant of ADP-beta-1,2-glycosyltransferase
MHHHHEGVLDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1169 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagaaggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1170 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISARLRARREEEMNAAAEELIQLCRNRNAYK

SEQ ID NO: 1171 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatctgaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaagcgcctgagagcgagacgcgaggaggaaatgaacgcagcggcggaagaactgatacagctgtgtcgcaaccgcaacgcctacaag

SEQ ID NO: 1172 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1173 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1174 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1175 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1176 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1177 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagaaggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1178 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISKRLRARREEEMNAAAEELIQLCRNRNAYK

SEQ ID NO: 1179 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1180 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1181 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1182 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1183 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcacgcgcctgagagcgagacgcgaggaggaaatgaacgcagcggcggaagaactgatacagctgtgtcgcaaccgcaacgcctacaag

SEQ ID NO: 1184 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISTRLRARREEEMNAAAEELIQLCRNRNAYK

SEQ ID NO: 1185 - DNA, 1350 bp, Artificial Sequence
  Variant of ADP-beta-1,2-glycosyltransferase
atgcaccatcatcatgaaggtgtgagtgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatctgaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcacgcgcctgagagcgagacgcgaggaggaaatgaacgcagcggcggaagaactgatacagctgtgtcgcaaccgcaacgcctacaag

SEQ ID NO: 1186 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISTRLRARREEEMNAAAEELIQLCRNRNAYK

SEQ ID NO: 1187 - DNA, 1350 bp, Artificial Sequence
  Variant of ADP-beta-1,2-glycosyltransferase
atgcaccatcatcatgaaaccgtgagtgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatctgaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1188 - protein, 450 aa, Artificial Sequence
  Variant of ADP-beta-1,2-glycosyltransferase
MHHHHETVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1189 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaagcgcctgagagcgagacgcgaggaggaaatgaacgcagcggcggaagaactgatacagctgtgtcgcaaccgcaacgcctacaag

SEQ ID NO: 1190 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1191 - DNA, 1350 bp, Artificial Sequence
  Variant of ADP-beta-1,2-glycosyltransferase
atgcaccatcatcatgaaggtgtgagtgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagaaggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1192 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISKRLRARREEEMNAAAEELIQLCRNRNAYK

SEQ ID NO: 1193 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1194 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1195 - DNA, 1350 bp, Artificial Sequence
  Variant of ADP-beta-1,2-glycosyltransferase
atgcaccatcatcatgaaaccgtgctggaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatctgaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1196 - protein, 450 aa, Artificial Sequence
  Variant of ADP-beta-1,2-glycosyltransferase
MHHHHETVLDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNLKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1197 - DNA, 1350 bp, Artificial Sequence
  Variant of ADP-beta-1,2-glycosyltransferase
atgcaccatcatcatgaaaccgtgagtgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1198 - protein, 450 aa, Artificial Sequence
  Variant of ADP-beta-1,2-glycosyltransferase
MHHHHETVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1199 - DNA, 1350 bp, Artificial Sequence
  Variant of ADP-beta-1,2-glycosyltransferase
atgcaccatcatcatgaaaccgtgctggaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1200 - protein, 450 aa, Artificial Sequence
  Variant of ADP-beta-1,2-glycosyltransferase
MHHHHETVLDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1201 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcttgaaagatgtgattatgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1202 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVIMGPTGEILRAKVRDISKRLRARREEEMNAAAEELIQLCRNRNAYK

SEQ ID NO: 1203 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1204 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1205 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatctgaagccggacctggtcctttacgattttttggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagaaggccgggtccaccgcggcgaaattgcccaagtcctgaaagatgtgatttcgggcccgactggtgagatactgcgcgcgaaagtacgcgacattagcaagcgcctgagagcgagacgcgaggaggaaatgaacgcagcggcggaagaactgatacagctgtgtcgcaaccgcaacgcctacaag

SEQ ID NO: 1206 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISKRLRARREEEMNAAAEELIQLCRNRNAYK

SEQ ID NO: 1207 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatctgaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcacgcgcctgagagcgagacgcgaggaggaaatgaacgcagcggcggaagaactgatacagctgtgtcgcaaccgcaacgcctacaag

SEQ ID NO: 1208 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISTRLRARREEEMNAAAEELIQLCRNRNAYK

SEQ ID NO: 1209 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1210 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1211 - DNA, 1350 bp, Artificial Sequence
  Variant of ADP-beta-1,2-glycosyltransferase
atgcaccatcatcatgaaggtgtgctggaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagaaggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1212 - protein, 450 aa, Artificial Sequence
  Variant of ADP-beta-1,2-glycosyltransferase
MHHHHEGVLDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISKRLRARREEEMNAAAEELIQLCRNRNAYK

SEQ ID NO: 1213 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1214 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1215 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1216 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1217 - DNA, 1350 bp, Artificial Sequence
  Variant of ADP-beta-1,2-glycosyltransferase
atgcaccatcatcatgaaaccgtgctggaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1218 - protein, 450 aa, Artificial Sequence
  Variant of ADP-beta-1,2-glycosyltransferase
MHHHHETVLDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1219 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagaaggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1220 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISKRLRARREEEMNAAAEELIQLCRNRNAYK

SEQ ID NO: 1221 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaagccctgaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1222 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQALKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1223 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatctgaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagaaggccgggtccaccgcggcgaaattgcccaagtcctgaaagatgtgatttcgggcccgactggtgagatactgcgcgcgaaagtacgcgacattagcacgcgcctgagagcgagacgcgaggaggaaatgaacgcagcggcggaagaactgatacagctgtgtcgcaaccgcaacgcctacaag

SEQ ID NO: 1224 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISTRLRARREEEMNAAAEELIQLCRNRNAYK

SEQ ID NO: 1225 - DNA, 1350 bp, Artificial Sequence
  Variant of ADP-beta-1,2-glycosyltransferase
atgcaccatcatcatgaaggtgtgagtgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaaccatttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1226 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNLKPDLVLYDFLVPWAEKVALEQGIPAVPLLTSGAALFSYFFNFLKRPGEPFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1227 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacatctgcatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1228 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHLHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1229 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1230 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1231 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaactgatcaaaaagagaatcccggagaaatacagtaatagcatccatctggttgagctggcgctgccagaattaccggaactgccaccacatctgcatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagagctgatacagctgtgtcgcaaccgcaacgcctacaag

SEQ ID NO: 1232 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLELIKKRIPEKYSNSIHLVELALPELPELPPHLHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1233 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgataaggctgtgtcgcaaccgcaacgcctacaag

SEQ ID NO: 1234 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIRLCRNRNAYK

SEQ ID NO: 1235 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccccgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1236 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEDGRVHRGEIAQVLKDVISGPTGEILRAKVRDISKRLRARREEEMNAAAEELIQLCRNRNAYK

SEQ ID NO: 1237 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcgacgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1238 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRDEIAQVLKDVISGPTGEILRAKVRDISKRLRARREEEMNAAAEELIQLCRNRNAYK

SEQ ID NO: 1239 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgcttggaacagagccgcccgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1240 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1241 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatatccctgtgtcgcaaccgcaacgcctacaag

SEQ ID NO: 1242 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELISLCRNRNAYK

SEQ ID NO: 1243 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccgcgtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1244 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIARVLKDVISGPTGEILRAKVRDISKRLRARREEEMNAAAEELIQLCRNRNAYK

SEQ ID NO: 1245 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatagcgctgtgtcgcaaccgcaacgcctacaag

SEQ ID NO: 1246 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIALCRNRNAYK

SEQ ID NO: 1247 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcagcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgccacgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1248 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRHEIAQVLKDVISGPTGEILRAKVRDISKRLRARREEEMNAAAEELIQLCRNRNAYK

SEQ ID NO: 1249 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgccggcgcaacgcctacaag

SEQ ID NO: 1250 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRRRNAYK

SEQ ID NO: 1251 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcgccgcctacaag

SEQ ID NO: 1252 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRAAYK

SEQ ID NO: 1253 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaagcgcaacgcctacaag

SEQ ID NO: 1254 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRKRNAYK

SEQ ID NO: 1255 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcccacaag

SEQ ID NO: 1256 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAHK

SEQ ID NO: 1257 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcccgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1258 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRVHRGEIAQVLKDVISGPTGEILRAKVRDISKRLRARREEEMNAAAEELIQLCRNRNAYK

SEQ ID NO: 1259 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcgcggaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1260 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRAEIAQVLKDVISGPTGEILRAKVRDISKRLRARREEEMNAAAEELIQLCRNRNAYK

SEQ ID NO: 1261 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagcacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1262 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQHLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1263 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcaacgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1264 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRNEIAQVLKDVISGPTGEILRAKVRDISKRLRARREEEMNAAAEELIQLCRNRNAYK

SEQ ID NO: 1265 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1266 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1267 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgataaagctgtgtcgcaaccgcaacgcctacaag

SEQ ID NO: 1268 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIKLCRNRNAYK

SEQ ID NO: 1269 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgctcggcctacaag

SEQ ID NO: 1270 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRSAYK

SEQ ID NO: 1271 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggttttgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcagggcctacaag

SEQ ID NO: 1272 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRRAYK

SEQ ID NO: 1273 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagcggctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1274 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1275 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcatgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1276 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIMRDEDGRVHRGEIAQVLKDVISGPTGEILRAKVRDISKRLRARREEEMNAAAEELIQLCRNRNAYK

SEQ ID NO: 1277 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactatctcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1278 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1279 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcgcggaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1280 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCAELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1281 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagacgctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1282 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQTLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1283 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagctgctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1284 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQLLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1285 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacgcgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1286 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKRENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1287 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatactgctgtgtcgcaaccgcaacgcctacaag

SEQ ID NO: 1288 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELILLCRNRNAYK

SEQ ID NO: 1289 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcgtggcctacaag

SEQ ID NO: 1290 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRVAYK

SEQ ID NO: 1291 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacaggcgctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1292 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQALEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAYK

SEQ ID NO: 1293 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgccgccaag

SEQ ID NO: 1294 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNAAK

SEQ ID NO: 1295 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgctgggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1296 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPLGEILRAKVRDISKRLRARREEEMNAAAEELIQLCRNRNAYK

SEQ ID NO: 1297 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacatcgcggcggaagaactgatacagctgtgtcgcaaccgcaacgcctacaag

SEQ ID NO: 1298 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNIAAEELIQLCRNRNAYK

SEQ ID NO: 1299 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcagcgaaattgcccaagtcctgaaagatgtgatttcgggcccgactggtgagatactgcgcgcgaaagtacgcgacattagcaaacgcctgagagcgagacgcgaggaggaaatgaacgcagcggcgctcgaactgatacagctgtgtcgcaaccgcaacgcctacaag

SEQ ID NO: 1300 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRSEIAQVLKDVISGPTGEILRAKVRDISKRLRARREEEMNAAALELIQLCRNRNAYK

SEQ ID NO: 1301 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagaagctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1302 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEKLRAKVRDISKRLRARREEEMNAAAEELIQLCRNRNAYK

SEQ ID NO: 1303 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaacgtacgcgacattagcaaacgcctgagagcgagacgcgaggaggaaatgaacgcagcggcggaagaactgatacagctgtgtcgcaaccgcaacgcctacaag

SEQ ID NO: 1304 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRANVRDISKRLRARREEEMNAAAEELIQLCRNRNAYK

SEQ ID NO: 1305 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcgtcaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 1306 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVVKDVISGPTGEILRAKVRDISKRLRARREEEMNAAAEELIQLCRNRNAYK

SEQ ID NO: 1307 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgccacgaag

SEQ ID NO: 1308 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISKRLRARREEEMNAAAEELIQLCRNRNATK

SEQ ID NO: 1309 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgcaaacgcagtgcctataag

SEQ ID NO: 1310 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEEGRVHRGEIAQVLKDVISGPTGEILRAKVRDISARLRARREEEMNAAAEELIRLCRKRSAYK

SEQ ID NO: 1311 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaatcgcgcagcccataag

SEQ ID NO: 1312 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRDEIARVLKDVISGPTGEILRAKVRDISARLRARREEEMNAAAEELIQLCRNRAAHK

SEQ ID NO: 1313 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagagggccgggtccaccgccatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcgcagcccataag

SEQ ID NO: 1314 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYLTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEEGRVHRHEIAQVLKDVISGPTGEILRAKVRDISARLRARREEEMNAAAEELIQLCRKRAAHK

SEQ ID NO: 1315 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaatcgcgcagcccataag

SEQ ID NO: 1316 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEDGRVHRGEIAQVLKDVISGPTGEILRAKVRDISARLRARREEEMNAAAEELIQLCRNRAAHK

SEQ ID NO: 1317 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1318 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEEGRVHRGEIAQVLKDVISGPTGEILRAKVRDISARLRARREEEMNAAAEELIQLCRNRNAYK

SEQ ID NO: 1319 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcgcagcctataag

SEQ ID NO: 1320 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEEGRVHRGEIAQVLKDVISGPTGEILRAKVRDISARLRARREEEMNAAAEELIQLCRKRAAYK

SEQ ID NO: 1321 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcaatgcccataag

SEQ ID NO: 1322 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRDEIARVLKDVISGPTGEILRAKVRDISARLRARREEEMNAAAEELIQLCRKRNAHK

SEQ ID NO: 1323 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgcaatcgcaatgcccataag

SEQ ID NO: 1324 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIRLCRNRNAHK

SEQ ID NO: 1325 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgactgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcgcagcctataag

SEQ ID NO: 1326 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPTEEDFLAPQNAGIMLMCTSRVIEAKYLDYLTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIARVLKDVISGPTGEILRAKVRDISARLRARREEEMNAAAEELIQLCRRRAAYK

SEQ ID NO: 1327 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgacggaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagatggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcgcagcccataag

SEQ ID NO: 1328 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRVHRDEIARVLKDVISGPTGEILRAKVRDISARLRARREEEMNAAAEELIQLCRRRAAHK

SEQ ID NO: 1329 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1330 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEEGRVHRGEIAQVLKDVISGPTGEILRAKVRDISARLRARREEEMNAAAEELIQLCRNRNAYK

SEQ ID NO: 1331 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcagtgcctataag

SEQ ID NO: 1332 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEIVRDEEGRVHRDEIARVLKDVISGPTGEILRAKVRDISARLRARREEEMNAAAEELIQLCRKRSAYK

SEQ ID NO: 1333 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgccatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgataagtctgtgtcgccgtcgcgcagcctataag

SEQ ID NO: 1334 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIVRDEDGRVHRHEIAQVLKDVISGPTGEILRAKVRDISARLRARREEEMNAAAEELISLCRRRAAYK

SEQ ID NO: 1335 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgcaatcgcgcagcctataag

SEQ ID NO: 1336 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIRLCRNRAAYK

SEQ ID NO: 1337 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgccgtcgcgcagcccataag

SEQ ID NO: 1338 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISARLRARREEEMNAAAEELIRLCRRRAAHK

SEQ ID NO: 1339 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcgatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgataagtctgtgtcgccgtcgcagtgcctataag

SEQ ID NO: 1340 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIVRDEDGRVHRDEIAQVLKDVISGPTGEILRAKVRDISARLRARREEEMNAAAEELISLCRRRSAYK

SEQ ID NO: 1341 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgccatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgccgtcgcgcagcctataag

SEQ ID NO: 1342 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRHEIAQVLKDVISGPTGEILRAKVRDISARLRARREEEMNAAAEELIRLCRRRAAYK

SEQ ID NO: 1343 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1344 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRDEIARVLKDVISGPTGEILRAKVRDISARLRARREEEMNAAAEELIQLCRNRNAYK

SEQ ID NO: 1345 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagagggccgggtccaccgcgatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgcaaacgcaatgcccataag

SEQ ID NO: 1346 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEEGRVHRDEIAQVLKDVISGPTGEILRAKVRDISARLRARREEEMNAAAEELIRLCRKRNAHK

SEQ ID NO: 1347 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcgccgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcgcagcctataag

SEQ ID NO: 1348 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYLTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRAEIAQVLKDVISGPTGEILRAKVRDISARLRARREEEMNAAAEELIQLCRKRAAYK

SEQ ID NO: 1349 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctataag

SEQ ID NO: 1350 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEDGRVHRGEIAQVLKDVISGPTGEILRAKVRDISARLRARREEEMNAAAEELIQLCRNRNAYK

SEQ ID NO: 1351 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1352 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIARVLKDVISGPTGEILRAKVRDISARLRARREEEMNAAAEELIQLCRNRNAYK

SEQ ID NO: 1353 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcgccgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1354 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRAEIAQVLKDVISGPTGEILRAKVRDISARLRARREEEMNAAAEELIQLCRNRNAYK

SEQ ID NO: 1355 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1356 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1357 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgcaaacgcgcagcccataag

SEQ ID NO: 1358 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEEGRVHRGEIAQVLKDVISGPTGEILRAKVRDISARLRARREEEMNAAAEELIRLCRKRAAHK

SEQ ID NO: 1359 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgccatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgataagtctgtgtcgcaaacgcgcagcccataag

SEQ ID NO: 1360 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRHEIARVLKDVISGPTGEILRAKVRDISARLRARREEEMNAAAEELISLCRKRAAHK

SEQ ID NO: 1361 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaatcgcaatgcctataag

SEQ ID NO: 1362 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRVHRGEIAQVLKDVISGPTGEILRAKVRDISARLRARREEEMNAAAEELIQLCRNRNAYK

SEQ ID NO: 1363 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1364 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1365 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgccatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1366 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRHEIAQVLKDVISGPTGEILRAKVRDISARLRARREEEMNAAAEELIQLCRNRNAYK

SEQ ID NO: 1367 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgccatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgcaaacgcagtgcccataag

SEQ ID NO: 1368 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIVRDEDGRVHRHEIARVLKDVISGPTGEILRAKVRDISARLRARREEEMNAAAEELIRLCRKRSAHK

SEQ ID NO: 1369 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgccatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaatcgcaatgcctataag

SEQ ID NO: 1370 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRHEIARVLKDVISGPTGEILRAKVRDISARLRARREEEMNAAAEELIQLCRNRNAYK

SEQ ID NO: 1371 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagatggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcgcagcctataag

SEQ ID NO: 1372 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEISRDEDGRVHRGEIARVLKDVISGPTGEILRAKVRDISARLRARREEEMNAAAEELIQLCRRRAAYK

SEQ ID NO: 1373 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgccgtcgcgcagcctataag

SEQ ID NO: 1374 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRDEIARVLKDVISGPTGEILRAKVRDISARLRARREEEMNAAAEELIRLCRRRAAYK

SEQ ID NO: 1375 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgccatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1376 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIVRDEDGRVHRHEIARVLKDVISGPTGEILRAKVRDISARLRARREEEMNAAAEELIQLCRNRNAYK

SEQ ID NO: 1377 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgtgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgcaaacgcgcagcccataag

SEQ ID NO: 1378 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRDEIARVLKDVISGPTGEILRAKVRDISARLRARREEEMNAAAEELIRLCRKRAAHK

SEQ ID NO: 1379 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1380 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISARLRARREEEMNAAAEELIQLCRNRNAYK

SEQ ID NO: 1381 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaatcgcagtgcccataag

SEQ ID NO: 1382 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISARLRARREEEMNAAAEELIQLCRNRSAHK

SEQ ID NO: 1383 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgccatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1384 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYLTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRHEIAQVLKDVISGPTGEILRAKVRDISARLRARREEEMNAAAEELIQLCRNRNAYK

SEQ ID NO: 1385 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgccatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcgcagcctataag

SEQ ID NO: 1386 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRHEIAQVLKDVISGPTGEILRAKVRDISARLRARREEEMNAAAEELIQLCRKRAAYK

SEQ ID NO: 1387 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagatggccgggtccaccgcgatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1388 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRVHRDEIAQVLKDVISGPTGEILRAKVRDISARLRARREEEMNAAAEELIQLCRNRNAYK

SEQ ID NO: 1389 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagagggccgggtccaccgccatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgataagtctgtgtcgccgtcgcaatgcctataag

SEQ ID NO: 1390 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEEGRVHRHEIAQVLKDVISGPTGEILRAKVRDISARLRARREEEMNAAAEELISLCRRRNAYK

SEQ ID NO: 1391 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaatcgcaatgcccataag

SEQ ID NO: 1392 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRVHRGEIAQVLKDVISGPTGEILRAKVRDISARLRARREEEMNAAAEELIQLCRNRNAHK

SEQ ID NO: 1393 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcaatgcctataag

SEQ ID NO: 1394 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEIPRDEDGRVHRGEIARVLKDVISGPTGEILRAKVRDISARLRARREEEMNAAAEELIQLCRRRNAYK

SEQ ID NO: 1395 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1396 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1397 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1398 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEIVRDEDGRVHRGEIARVLKDVISGPTGEILRAKVRDISARLRARREEEMNAAAEELIQLCRNRNAYK

SEQ ID NO: 1399 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1400 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIARVLKDVISGPTGEILRAKVRDISARLRARREEEMNAAAEELIQLCRNRNAYK

SEQ ID NO: 1401 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgactgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1402 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPTEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISARLRARREEEMNAAAEELIQLCRNRNAYK

SEQ ID NO: 1403 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1404 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYLTELTNVKVVPVGPPFQDPLTEDIDDPELMDWLDTKPEHSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1405 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagagggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1406 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEEGRVHRGEIARVLKDVISGPTGEILRAKVRDISARLRARREEEMNAAAEELIQLCRNRNAYK

SEQ ID NO: 1407 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcgcagcccataag

SEQ ID NO: 1408 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEDGRVHRGEIAQVLKDVISGPTGEILRAKVRDISARLRARREEEMNAAAEELIQLCRRRAAHK

SEQ ID NO: 1409 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaatcgcaatgcctataag

SEQ ID NO: 1410 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1411 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1412 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISARLRARREEEMNAAAEELIQLCRNRNAYK

SEQ ID NO: 1413 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagagggccgggtccaccgcgatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgcaaacgcgcagcctataag

SEQ ID NO: 1414 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEEGRVHRDEIAQVLKDVISGPTGEILRAKVRDISARLRARREEEMNAAAEELIRLCRKRAAYK

SEQ ID NO: 1415 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgccatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1416 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRHEIAQVLKDVISGPTGEILRAKVRDISARLRARREEEMNAAAEELIQLCRNRNAYK

SEQ ID NO: 1417 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1418 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1419 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1420 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRDEIARVLKDVISGPTGEILRAKVRDISARLRARREEEMNAAAEELIQLCRNRNAYK

SEQ ID NO: 1421 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaacggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagagggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcaatgcctataag

SEQ ID NO: 1422 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPNGFLERVGDRGRVLDHLVPQAHILNHPSTGGFISHCGWNSVMESIDFGVPIIAMPMQWDQPINARLLVELGVAVEISRDEEGRVHRDEIARVLKDVISGPTGEILRAKVRDISARLRARREEEMNAAAEELIQLCRKRNAYK

SEQ ID NO: 1423 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagagggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgccgtcgcgcagcccataag

SEQ ID NO: 1424 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEEGRVHRDEIARVLKDVISGPTGEILRAKVRDISARLRARREEEMNAAAEELIRLCRRRAAHK

SEQ ID NO: 1425 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagatggccgggtccaccgcgatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1426 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRVHRDEIAQVLKDVISGPTGEILRAKVRDISARLRARREEEMNAAAEELIQLCRNRNAYK

SEQ ID NO: 1427 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgcaaacgcgcagcccataag

SEQ ID NO: 1428 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRVHRAEIARVLKDVISGPTGEILRAKVRDISARLRARREEEMNAAAEELIRLCRKRAAHK

SEQ ID NO: 1429 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgccatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcgcagcccataag

SEQ ID NO: 1430 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYLTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRHEIAQVLKDVISGPTGEILRAKVRDISARLRARREEEMNAAAEELIQLCRRRAAHK

SEQ ID NO: 1431 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcaatgcctataag

SEQ ID NO: 1432 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISARLRARREEEMNAAAEELIQLCRKRNAYK

SEQ ID NO: 1433 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcgcagcctataag

SEQ ID NO: 1434 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRDEIARVLKDVISGPTGEILRAKVRDISARLRARREEEMNAAAEELIQLCRKRAAYK

SEQ ID NO: 1435 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaatcgcgcagcccataag

SEQ ID NO: 1436 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIARVLKDVISGPTGEILRAKVRDISARLRARREEEMNAAAEELIQLCRNRAAHK

SEQ ID NO: 1437 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgccatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgataagtctgtgtcgcaatcgcagtgcccataag

SEQ ID NO: 1438 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRHEIARVLKDVISGPTGEILRAKVRDISARLRARREEEMNAAAEELISLCRNRSAHK

SEQ ID NO: 1439 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcgcagcctataag

SEQ ID NO: 1440 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRVHRAEIARVLKDVISGPTGEILRAKVRDISARLRARREEEMNAAAEELIQLCRRRAAYK

SEQ ID NO: 1441 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcgccgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaatcgcaatgcctataag

SEQ ID NO: 1442 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRAEIAQVLKDVISGPTGEILRAKVRDISARLRARREEEMNAAAEELIQLCRNRNAYK

SEQ ID NO: 1443 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1444 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEIPRDEDGRVHRGEIARVLKDVISGPTGEILRAKVRDISARLRARREEEMNAAAEELIQLCRNRNAYK

SEQ ID NO: 1445 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1446 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISARLRARREEEMNAAAEELIQLCRNRNAYK

SEQ ID NO: 1447 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcgatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcagtgcctataag

SEQ ID NO: 1448 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRDEIAQVLKDVISGPTGEILRAKVRDISARLRARREEEMNAAAEELIQLCRRRSAYK

SEQ ID NO: 1449 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1450 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIARVLKDVISGPTGEILRAKVRDISARLRARREEEMNAAAEELIQLCRNRNAYK

SEQ ID NO: 1451 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1452 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEDGRVHRDEIAQVLKDVISGPTGEILRAKVRDISARLRARREEEMNAAAEELIQLCRNRNAYK

SEQ ID NO: 1453 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcgatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcgcagcctataag

SEQ ID NO: 1454 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRDEIAQVLKDVISGPTGEILRAKVRDISARLRARREEEMNAAAEELIQLCRKRAAYK

SEQ ID NO: 1455 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgccatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcaatgcctataag

SEQ ID NO: 1456 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEIVRDEEGRVHRHEIAQVLKDVISGPTGEILRAKVRDISARLRARREEEMNAAAEELIQLCRRRNAYK

SEQ ID NO: 1457 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagatggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgataagtctgtgtcgccgtcgcaatgcccataag

SEQ ID NO: 1458 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEISRDEDGRVHRGEIARVLKDVISGPTGEILRAKVRDISARLRARREEEMNAAAEELISLCRRRNAHK

SEQ ID NO: 1459 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgataagtctgtgtcgccgtcgcgcagcccataag

SEQ ID NO: 1460 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRGEIAQVLKDVISGPTGEILRAKVRDISARLRARREEEMNAAAEELISLCRRRAAHK

SEQ ID NO: 1461 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagagggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1462 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEEGRVHRGEIARVLKDVISGPTGEILRAKVRDISARLRARREEEMNAAAEELIQLCRNRNAYK

SEQ ID NO: 1463 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcgcagcctataag

SEQ ID NO: 1464 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEDGRVHRGEIAQVLKDVISGPTGEILRAKVRDISARLRARREEEMNAAAEELIQLCRRRAAYK

SEQ ID NO: 1465 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagagggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgataagtctgtgtcgccgtcgcgcagcccataag

SEQ ID NO: 1466 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYLTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEEGRVHRGEIAQVLKDVISGPTGEILRAKVRDISARLRARREEEMNAAAEELISLCRRRAAHK

SEQ ID NO: 1467 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagagggccgggtccaccgcgatgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgataagtctgtgtcgcaaacgcagtgcctacaag

SEQ ID NO: 1468 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEIPRDEEGRVHRDEIARVLKDVISGPTGEILRAKVRDISARLRARREEEMNAAAEELISLCRKRSAYK

SEQ ID NO: 1469 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagagggccgggtccaccgcgatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacgtctgtgtcgcaatcgcgcagcccataag

SEQ ID NO: 1470 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYLTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEEGRVHRDEIAQVLKDVISGPTGEILRAKVRDISARLRARREEEMNAAAEELIRLCRNRAAHK

SEQ ID NO: 1471 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccgggtccaccgcgatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcaatgcccataag

SEQ ID NO: 1472 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRDEIAQVLKDVISGPTGEILRAKVRDISARLRARREEEMNAAAEELIQLCRKRNAHK

SEQ ID NO: 1473 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagagggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1474 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEEGRVHRGEIARVLKDVISGPTGEILRAKVRDISARLRARREEEMNAAAEELIQLCRNRNAYK

SEQ ID NO: 1475 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgataagtctgtgtcgccgtcgcagtgcccataag

SEQ ID NO: 1476 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRVHRGEIAQVLKDVISGPTGEILRAKVRDISARLRARREEEMNAAAEELISLCRRRSAHK

SEQ ID NO: 1477 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcgcagcctataag

SEQ ID NO: 1478 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEDGRVHRGEIARVLKDVISGPTGEILRAKVRDISARLRARREEEMNAAAEELIQLCRRRAAYK

SEQ ID NO: 1479 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgataagtctgtgtcgcaaacgcagtgcctataag

SEQ ID NO: 1480 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEIPRDEDGRVHRGEIARVLKDVISGPTGEILRAKVRDISARLRARREEEMNAAAEELISLCRKRSAYK

SEQ ID NO: 1481 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagtatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgactgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcgcgtgatgaagagggccgggtccaccgcggcgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcaatgcccataag

SEQ ID NO: 1482 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEEGRVHRGEIARVLKDVISGPTGEILRAKVRDISARLRARREEEMNAAAEELIQLCRRRNAHK

SEQ ID NO: 1483 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcgcagcctataag

SEQ ID NO: 1484 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQHLEDVLPKGFLERVGDRGRVLDHLVPQAHILNHPSTGGFISHCGWNSVMESIDFGVPIIAMPMQWDQPINARLLVELGVAVEIPRDEDGRVHRGEIAQVLKDVISGPTGEILRAKVRDISARLRARREEEMNAAAEELIQLCRKRAAYK

SEQ ID NO: 1485 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgctgggaacagagccgcctgaagaagattttttagcacctcaaaatgccgggatcatgctgatgtgcacgagccgcgtaattgaggctaagtacctggactatctgaccgaactgaccaatgtaaaagttgttccggttggtccgccgtttcaggatccgctgaccgaagatattgacgaccccgaactgatggattggttagataccaaacccgaaaatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaacgcgcagcctataag

SEQ ID NO: 1486 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMLGTEPPEEDFLAPQNAGIMLMCTSRVIEAKYLDYLTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEDGRVHRGEIAQVLKDVISGPTGEILRAKVRDISARLRARREEEMNAAAEELIQLCRKRAAYK

SEQ ID NO: 1487 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1488 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1489 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagagggccgggtccaccgcgatgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgccgtcgcgcagcccataag

SEQ ID NO: 1490 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEEGRVHRDEIAQVLKDVISGPTGEILRAKVRDISARLRARREEEMNAAAEELIQLCRRRAAHK

SEQ ID NO: 1491 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcctttctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1492 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFLSHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1493 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttccagttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1494 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFQFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1495 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaactggcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1496 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEELAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1497 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccgagtttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1498 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPEFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1499 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagcttcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1500 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKLREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1501 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacattgccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1502 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTLPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1503 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgtgcgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1504 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVVRFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1505 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacaagaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1506 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNKTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1507 - DNA, 1350 bp, Artificial Sequence
  Variant of ADP-beta-1,2-glycosyltransferase
atgcaccatcatcatgaaggcgtgagcgaccagaccctgactgtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1508 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1509 - DNA, 1350 bp, Artificial Sequence
  Variant of ADP-beta-1,2-glycosyltransferase
atgcaccatcatagtgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1510 - protein, 450 aa, Artificial Sequence
  Variant of ADP-beta-1,2-glycosyltransferase
MHHHSEGVSDQTLRVTMFPWLGLGHVNPFLRIAKQLADRGFVIYLVSTAINLESIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1511 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcgcctgccagaattaccggaactgccaccacattaccatactaccaacggtttaccaccgcatctgaacccgaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgacggaagaagattttttagcacctcaaaatgccgggatcatgctgatgtgcacgagccgcgtaattgaggctaagtacctggactattgcaccgaactgaccaatgtaaaagttgttccggttggtccgccgtttcaggatccgctgaccgaagatattgacgaccccgaactgatggattggttagataccaaacccgaaaacagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagacggccgggtccaccgcggcgaaattgcccaagtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1512 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLESIKKRIPEKYSNSIHLVELRLPELPELPPHYHTTNGLPPHLNPTLHKALKMSAPNFSKILQNIKPDLVLYDFLVPWAEKVALEQGIPAVPLLTSGAALFSYFFNFLKRPGEEFPFEAIRLSKREQDKMREMFGTEPTEEDFLAPQNAGIMLMCTSRVIEAKYLDYCTELTNVKVVPVGPPFQDPLTEDIDDPELMDWLDTKPENSVVYVSFGSEYFLSREDMEEVAFGLELSGVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRVHRGEIAQVLKDVISGPTGEILRAKVRDISARLRARREEEMNAAAEELIQLCRNRNAYK

SEQ ID NO: 1513 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaaccctaccctgcacaaggcactgaagatgagcgctcccgaatttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaatttcctgaagcgaccgggtgaagagtttccgtttgaggcaatccgcctgtcgaagcgagaacaggataagctgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtggcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcctgtctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1514 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAINLEMIKKRIPEKYSNSIHLVELRLPELPELPPHYHTTNGLPPHLNPTLHKALKMSAPEFSKILQNIKPDLVLYDFLVPWAEKVALEQGIPAVPLLTSGAALFSYFFNFLKRPGEEFPFEAIRLSKREQDKLREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFLSHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1515 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaatttcctgaagcgaccgggtgaagagtttccgtttgaggcaatccgcctgtcgaagcgagaacaggataagatgcgcgagatgtttggaacactgccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1516 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTLPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1517 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcaccatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaatttcctgaagcgaccgggtgaagagtttccgtttgaggcaatccgcctgtcgaagcgagaacaggataagatgcgcgagatgtttggaacactgccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtggcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcctgtctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1518 - protein, 450 aa, Artificial Sequence
  Variant of ADP-beta-1,2-glycosyltransferase
MHHHHEGVSDQTLRVTMFPWLGLGHVNPFLRIAKQLADRGFTIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTLPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFLSHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1519 - DNA, 1350 bp, Artificial Sequence
  Variant of ADP-beta-1,2-glycosyltransferase
atgcaccatcatcatgaaggcgtgagcgaccagaccctgcgtgtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagctgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1520 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKLREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1521 - DNA, 1350 bp, Artificial Sequence
  Variant of ADP-beta-1,2-glycosyltransferase
atgcaccatcatcatgaaggcgtgagcgaccagaccctgcgtgtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaaccctaccctgcacaaggcactgaagatgagcgctcccgaatttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaatttcctgaagcgaccgggtgaagagtttccgtttgaggcaatccgcctgtcgaagcgagaacaggataagatgcgcgagatgtttggaacactgccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcctgtctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1522 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNPTLHKALKMSAPEFSKILQNIKPDLVLYDFLVPWAEKVALEQGIPAVPLLTSGAALFSYFFNFLKRPGEEFPFEAIRLSKREQDKMREMFGTLPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFLSHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1523 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacaaaaccctgcacaaggcactgaagatgagcgctcccaattttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1524 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAINLEMIKKRIPEKYSNSIHLVELRLPELPELPPHYHTTNGLPPHLNKTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1525 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacaaaaccctgcacaaggcactgaagatgagcgctcccgaatttagcaagatccttcaaaatattaagccggacctggtcctttacgattttctggttccgtgggcagaaaaaatcgcgcttgaacagggcatcccggctgttccattgctaaccagtggtgcggcactgtttagctactttttcaatttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtggcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1526 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAINLEMIKKRIPEKYSNSIHLVELRLPELPELPPHYHTTNGLPPHLNKTLHKALKMSAPEFSKILQNIKPDLVLYDFLVPWAEKIALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1527 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccgaatttagcaagatccttcaaaatattaagccggacctggtcctttacgattttctggttccgtgggcagaaaaagtcgcgcttgaacagggcatcccggctgttccattgctaaccagtggtgcggcactgtttagctactttttccaattcctgaagcgaccgggtgaagagtttccgtttgaggcaatccgcctgtcgaagcgagaacaggataagatgcgcgagatgtttggaacactgccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1528 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAINLEMIKKRIPEKYSNSIHLVELRLPELPELPPHYHTTNGLPPHLNGTLHKALKMSAPEFSKILQNIKPDLVLYDFLVPWAEKVALEQGIPAVPLLTSGAALFSYFFQFLKRPGEEFPFEAIRLSKREQDKMREMFGTLPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1529 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattgtactcgaaatgatcaaaaagagaatcccggagaaatacagtaatagcatccatctggttgagctgcgcctgccagaattaccggaactgccaccacattaccatactaccaacggtttaccaccgcatctgaaccctaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttccaattcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcctgtctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1530 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAIVLEMIKKRIPEKYSNSIHLVELRLPELPELPPHYHTTNGLPPHLNPTLHKALKMSAPNFSKILQNIKPDLVLYDFLVPWAEKVALEQGIPAVPLLTSGAALFSYFFQFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFLSHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1531 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcaccatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtggcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcctgtctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1532 - protein, 450 aa, Artificial Sequence
  Variant of ADP-beta-1,2-glycosyltransferase
MHHHHEGVSDQTLTVTMFPWLGLGHVNPFLRIAKQLADRGFTIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFLSHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1533 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacaaaaccctgcacaaggcactgaagatgagcgctcccaattttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaatttcctgaagcgaccgggtgaagagtttccgtttgaggcaatccgcctgtcgaagcgagaacaggataagatgcgcgagatgtttggaacactgccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1534 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNKTLHKALKMSAPNFSKILQNIKPDLVLYDFLVPWAEKVALEQGIPAVPLLTSGAALFSYFFNFLKRPGEEFPFEAIRLSKREQDKMREMFGTLPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1535 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcaccatctatttagttagtaccgctattgtactcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaattttagcaagatccttcaaaatattaagccggacctggtcctttacgattttctggttccgtgggcagaaaaagtcgcgcttgaacagggcatcccggctgttccattgctaaccagtggtgcggcactgtttagctactttttccaattcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtggcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcctgtctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1536 - protein, 450 aa, Artificial Sequence
  Variant of ADP-beta-1,2-glycosyltransferase
MHHHHEGVSDQTLTVTMFPWLGLGHVNPFLRIAKQLADRGFTIYLVSTAIVLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFQFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFLSHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1537 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattgtactcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccgaatttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1538 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAIVLEMIKKRIPEKYSNSIHLVELRLPELPELPPHYHTTNGLPPHLNGTLHKALKMSAPEFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1539 - DNA, 1350 bp, Artificial Sequence
  Variant of ADP-beta-1,2-glycosyltransferase
atgcaccatcatcatgaaggcgtgagcgaccagaccctgcgtgtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaaccctaccctgcacaaggcactgaagatgagcgctcccgaatttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaatttcctgaagcgaccgggtgaagagtttccgtttgaggcaatccgcctgtcgaagcgagaacaggataagatgcgcgagatgtttggaacactgccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1540 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNPTLHKALKMSAPEFSKILQNIKPDLVLYDFLVPWAEKVALEQGIPAVPLLTSGAALFSYFFNFLKRPGEEFPFEAIRLSKREQDKMREMFGTLPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1541 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcaccatctatttagttagtaccgctattgtactcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccgaatttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaatttcctgaagcgaccgggtgaagagtttccgtttgaggcaatccgcctgtcgaagcgagaacaggataagctgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtggcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1542 - protein, 450 aa, Artificial Sequence
  Variant of ADP-beta-1,2-glycosyltransferase
MHHHHEGVSDQTLTVTMFPWLGLGHVNPFLRIAKQLADRGFTIYLVSTAIVLEMIKKRIPEKYSNSIHLVELRLPELPELPPHYHTTNGLPPHLNGTLHKALKMSAPEFSKILQNIKPDLVLYDFLVPWAEKVALEQGIPAVPLLTSGAALFSYFFNFLKRPGEEFPFEAIRLSKREQDKLREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1543 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattgtactcgaaatgatcaaaaagagaatcccggagaaatacagtaatagcatccatctggttgagctgcgcctgccagaattaccggaactgccaccacattaccatactaccaacggtttaccaccgcatctgaacaaaaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttccaattcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtggcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1544 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAIVLEMIKKRIPEKYSNSIHLVELRLPELPELPPHYHTTNGLPPHLNKTLHKALKMSAPNFSKILQNIKPDLVLYDFLVPWAEKVALEQGIPAVPLLTSGAALFSYFFQFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1545 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaactggcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1546 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEELAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1547 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattgtactcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcctgtctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1548 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAIVLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFLSHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1549 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccgaatttagcaagatccttcaaaatattaagccggacctggtcctttacgattttctggttccgtgggcagaaaaagtcgcgcttgaacagggcatcccggctgttccattgctaaccagtggtgcggcactgtttagctactttttccaattcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1550 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAINLEMIKKRIPEKYSNSIHLVELRLPELPELPPHYHTTNGLPPHLNGTLHKALKMSAPEFSKILQNIKPDLVLYDFLVPWAEKVALEQGIPAVPLLTSGAALFSYFFQFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1551 - DNA, 1350 bp, Artificial Sequence
  Variant of ADP-beta-1,2-glycosyltransferase
atgcaccatcatcatgaaggcgtgagcgaccagaccctgcgtgtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaaccctaccctgcacaaggcactgaagatgagcgctcccgaatttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaatttcctgaagcgaccgggtgaagagtttccgtttgaggcaatccgcctgtcgaagcgagaacaggataagctgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgtccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1552 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNPTLHKALKMSAPEFSKILQNIKPDLVLYDFLVPWAEKVALEQGIPAVPLLTSGAALFSYFFNFLKRPGEEFPFEAIRLSKREQDKLREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVVRFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1553 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacaaaaccctgcacaaggcactgaagatgagcgctcccgaatttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagtgccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1554 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAINLEMIKKRIPEKYSNSIHLVELRLPELPELPPHYHTTNGLPPHLNKTLHKALKMSAPEFSKILQNIKPDLVLYDFLVPWAEKVALEQGIPAVPLLTSGAALFSYFFNFLKRPGEEFPFEAIRLSKREQDKMREMFGTVPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1555 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacaaaaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcctgtctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1556 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAINLEMIKKRIPEKYSNSIHLVELRLPELPELPPHYHTTNGLPPHLNKTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFLSHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1557 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaattttagcaagatccttcaaaatattaagccggacctggtcctttacgattttctggttccgtgggcagaaaaagtcgcgcttgaacagggcatcccggctgttccattgctaaccagtggtgcggcactgtttagctactttttccaattcctgaagcgaccgggtgaagagtttccgtttgaggcaatccgcctgtcgaagcgagaacaggataagctgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaactggcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1558 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFQFLKRPGEEFPFEAIRLSKREQDKLREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEELAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1559 - DNA, 1350 bp, Artificial Sequence
  Variant of ADP-beta-1,2-glycosyltransferase
atgcaccatcatcatgaaggcgtgagcgaccagaccctgcgtgtaacgatgtttccgtggcttgggctgggtcatgttaacccgtttttgcgtatcgctaaacaactggccgatcgtggtttcaccatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaaccctaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttccaattcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtggcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcctgtctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1560 - protein, 450 aa, Artificial Sequence
  Variant of ADP-beta-1,2-glycosyltransferase
MHHHHEGVSDQTLRVTMFPWLGLGHVNPFLRIAKQLADRGFTIYLVSTAINLEMIKKRIPEKYSNSIHLVELRLPELPELPPHYHTTNGLPPHLNPTLHKALKMSAPNFSKILQNIKPDLVLYDFLVPWAEKVALEQGIPAVPLLTSGAALFSYFFQFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFLSHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1561 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtggcgttcggcctggagctgagcggcgtgaactttatctgggttgtccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1562 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVVRFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1563 - DNA, 1350 bp, Artificial Sequence
  Variant of ADP-beta-1,2-glycosyltransferase
atgcaccatcatcatgaaggcgtgagcgaccagaccctgacggtaacgatgtttccgtggcttgggctgggtcatgttaacccgtttttgcgtatcgctaaacaactggccgatcgtggtttcgttatctatttagttagtaccgctattgtactcgaaatgatcaaaaagagaatcccggagaaatacagtaatagcatccatctggttgagctgcgcctgccagaattaccggaactgccaccacattaccatactaccaacggtttaccaccgcatctgaaccctaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaatttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtggcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcctgtctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1564 - protein, 450 aa, Artificial Sequence
  Variant of ADP-beta-1,2-glycosyltransferase
MHHHHEGVSDQTLTVTMFPWLGLGHVNPFLRIAKQLADRGFVIYLVSTAIVLEMIKKRIPEKYSNSIHLVELRLPELPELPPHYHTTNGLPPHLNPTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFLSHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1565 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1566 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDKLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1567 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagttcctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1568 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLVPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1569 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcagtgcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1570 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAVQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1571 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaagctttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1572 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEAFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1573 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttaccgcctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1574 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLPPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1575 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgcccctatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1576 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAPIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1577 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaacaggccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1578 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQQAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1579 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaaaggagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1580 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGKEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1581 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccgtctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1582 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDRLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1583 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttaatgcctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1584 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLMPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1585 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaacctttggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1586 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTFGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1587 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcaccttttaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1588 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPFNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1589 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaggggccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1590 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQGAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1591 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctgctaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1592 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPANAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1593 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccagtgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1594 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPVLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1595 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcgtgtacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1596 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVVYDFLVPWAEKVALEQGIPAVPLLTSGAALFSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1597 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaatcggccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1598 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQSAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1599 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagcgccggcccaggccggtatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaagcgttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1600 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPAQAGIMLMCTSRVIEAKYLDYCTELTNVKVVPVGPPFQDPLTEDIDDPELMDWLDTKPEHSVVYVSFGSEAFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1601 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccggtatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1602 - protein, 450 aa, Artificial Sequence; identical to SEQ ID NO: 1566
  Variant of ADP-beta-1,2-glycosyltransferase

SEQ ID NO: 1603 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagtgccgcaaaacgccccgatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1604 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLVPQNAPIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1605 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtacagctactttttcaacttcctgaagcgaccgggtgaagagtttccgtttgaggcaatccgcctgtcgaagcgagaacaggataagatgcgcgagatgtttggaacagagccgcctgaagaagattttttagtgccggcccaggccggtatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1606 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALYSYFFNFLKRPGEEFPFEAIRLSKREQDKMREMFGTEPPEEDFLVPAQAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDKLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1607 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaatctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagtgccggcccaggccccgatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatatttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1608 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLVPAQAPIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1609 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagtgccgttcaacgccccgatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1610 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLVPFNAPIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1611 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtttagctactttttcaacttcctgaagcgaccgggtgaagagtttccgtttgaggcaatccgcctgtcgaagcgagaacaggataagatgcgcgagatgtttggaacagagccgcctgaagaagattttttagcgccgcaaaacgccccgatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatatttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1612 - protein, 450 aa, Artificial Sequence; identical to SEQ ID NO: 1576
  Variant of ADP-beta-1,2-glycosyltransferase

SEQ ID NO: 1613 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtacagctactttttcaacttcctgaagcgaccgggtgaagagtttccgtttgaggcaatccgcctgtcgaagcgagaacaggataagatgcgcgagatgtttggaacagagccgcctgaagaagattttttagtgccgcaaaacgccccgatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatatttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1614 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALYSYFFNFLKRPGEEFPFEAIRLSKREQDKMREMFGTEPPEEDFLVPQNAPIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDKLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1615 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagcgccgttccaggccccgatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1616 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPFQAPIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDKLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1617 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccttcggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagtgccgcaaaacgccccgatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatatttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1618 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTFGAALFSYFFNFLKRPGEEFPFEAIRLSKREQDKMREMFGTEPPEEDFLVPQNAPIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1619 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagcgccggccaacgccggtatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatatttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1620 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPANAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDKLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1621 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagcgccgcaacaggccccgatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatatttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1622 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQQAPIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1623 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtacagctactttttcaacttcctgaagcgaccgggtgaagagtttccgtttgaggcaatccgcctgtcgaagcgagaacaggataagatgcgcgagatgtttggaacagagccgcctgaagaagattttttagtgccgcaacaggccggtatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatatttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1624 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALYSYFFNFLKRPGEEFPFEAIRLSKREQDKMREMFGTEPPEEDFLVPQQAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1625 - DNA, 1350 bp, Artificial Sequence; identical to SEQ ID NO: 1487
  Variant of ADP-beta-1,2-glycosyltransferase

SEQ ID NO: 1626 - protein, 450 aa, Artificial Sequence; identical to SEQ ID NO: 1488
  Variant of ADP-beta-1,2-glycosyltransferase

SEQ ID NO: 1627 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagtgccggccaacgccggtatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1628 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLVPANAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDKLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1629 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagtgccgttccaggccccgatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1630 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLVPFQAPIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDKLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1631 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtacagctactttttcaacttcctgaagcgaccgggtgaagagtttccgtttgaggcaatccgcctgtcgaagcgagaacaggataagatgcgcgagatgtttggaacggagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatatttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1632 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALYSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1633 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagcgccgcaaaacgccccgatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatatttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1634 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPQNAPIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDKLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1635 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtacagctactttttcaacttcctgaagcgaccgggtgaagagtttccgtttgaggcaatccgcctgtcgaagcgagaacaggataagatgcgcgagatgtttggaaaggagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatatttcctgagccgtgaagatatggaagaagtcgcgttcggcctggagctgagcggcgtgaactttatctgggttgcccgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1636 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALYSYFFNFLKRPGEEFPFEAIRLSKREQDKMREMFGKEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDKLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1637 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagcgccggccaacgccccgatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatatttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1638 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPANAPIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDKLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1639 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgtacagctactttttcaacttcctgaagcgaccgggtgaagagtttccgtttgaggcaatccgcctgtcgaagcgagaacaggataagatgcgcgagatgtttggaacagagccgcctgaagaagattttttagcacctcaaaatgccgggatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaatacttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggacaagctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1640 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNGTLHKALKMSAPNFSKILQNIKPDLVLYDFLVPWAEKVALEQGIPAVPLLTSGAALYSYFFNFLKRPGEEFPFEAIRLSKREQDKMREMFGTEPPEEDFLAPQNAGIMLMCTSRVIEAKYLDYCTELTNVKVVPVGPPFQDPLTEDIDDPELMDWLDTKPEHSVVYVSFGSEYFLSREDMEEVAFGLELSGVNFIWVARFPKGEEQRLEDVLPKGFLERVGDRGRVLDKLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1641 - DNA, 1350 bp, Artificial Sequence
  Variant of ADP-beta-1,2-glycosyltransferase
atgcaccatcatcatgaaggcgtgagcgaccagaccctgagagtaacgatgtttccgtggcttgggctgggtcatgttaacccgtttttgcgtatcgctaaacaactggccgatcgtggtttcgttatctatttagttagtaccgctattaacctcgaaatgatcaaaaagagaatcccggagaaatacagtaatagcatccatctggttgagctgcgcctgccagaattaccggaactgccaccacattaccatactaccaacggtttaccaccgcatctgaacaaaaccctgcacaaggcactgaagatgagcgctcccaactttagcaagatccttcaaaatattaagccggacctggtcctttacgattttctggttccgtgggcagaaaaagtcgcgcttgaacagggcatcccggctgttccattgctaaccagtggtgcggcactgttcagctactttttcaacttcctgaagcgaccgggtgaagagtttccgtttgaggcaatccgcctgtcgaagcgagaacaggataagatgcgcgagatgtttggaacagagccgcctgaagaagattttttagcgccggcccaggccggtatcatgctgatgtgcacgagccgcgtaattgaggctaagtacctggactattgtaccgaactgaccaatgtaaaagttgttccggttggtccgccgtttcaggatccgctgaccgaagatattgacgaccccgaactgatggattggttagataccaaacccgaacatagtgttgtctatgtgtcgtttggcagcgaagcgttcctgagccgtgaagatatggaagaagtcgcgttcggcctggagctgagcggcgtgaactttatctgggttgcacgctttccgaaaggcgaagaacagcgtctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccgcgtgatgaagatggccgggtccaccgcgccgaaattgcccgtgtcctgaaagatgtgatttcgggcccgactggtgagatactgcgcgcgaaagtacgcgacattagcgcacgcctgagagcgagacgcgaggaggaaatgaacgcagcggcggaagaactgatacagctgtgtcgcaaccgcaacgcctacaag

SEQ ID NO: 1642 - protein, 450 aa, Artificial Sequence
  Variant of ADP-beta-1,2-glycosyltransferase
MHHHHEGVSDQTLRVTMFPWLGLGHVNPFLRIAKQLADRGFVIYLVSTAINLEMIKKRIPEKYSNSIHLVELRLPELPELPPHYHTTNGLPPHLNKTLHKALKMSAPNFSKILQNIKPDLVLYDFLVPWAEKVALEQGIPAVPLLTSGAALFSYFFNFLKRPGEEFPFEAIRLSKREQDKMREMFGTEPPEEDFLAPAQAGIMLMCTSRVIEAKYLDYCTELTNVKVVPVGPPFQDPLTEDIDDPELMDWLDTKPEHSVVYVSFGSEAFLSREDMEEVAFGLELSGVNFIWVARFPKGEEQRLEDVLPKGFLERVGDRGRVLDHLVPQAHILNHPSTGGFISHCGWNSVMESIDFGVPIIAMPMQWDQPINARLLVELGVAVEIPRDEDGRVHRAEIARVLKDVISGPTGEILRAKVRDISARLRARREEEMNAAAEELIQLCRNRNAYK

SEQ ID NO: 1643 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1644 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1645 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgtagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1646 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1647 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatgtggaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1648 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1649 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatcgtcgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1650 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYRRTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1651 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1652 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1653 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagtacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1654 - protein, 793 aa, Artificial Sequence
  Variant of sucrose synthase
MIEELRQQLLDSPRSWRAFLRHLVASQRDSWLHTDLQRACSTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1655 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcgtgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1656 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRVYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1657 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1658 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1659 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgtcttattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1660 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1661 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1662 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1663 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgggttccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1664 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1665 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1666 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1667 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaaaggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1668 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAKDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1669 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttattgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1670 - protein, 793 aa, Artificial Sequence
  Variant of sucrose synthase
MIEELRQQLLDSPRSWRAFLRHLVASQRDSWLHTDLQRACKTFIEQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1671 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatatgatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1672 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYAYDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1673 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcaaggaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1674 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVKERYTWERYAERLMTIARCFGFWRFVLSRESQVMERYLQMFRHLQWRPLAHAVPME

SEQ ID NO: 1675 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtgctttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1676 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRALAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1677 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgccgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1678 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPPSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1679 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgccagacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1680 - protein, 793 aa, Artificial Sequence
  Variant of sucrose synthase
MIEELRQQLLDSPRSWRAFLRHLVASQRDSWLHTDLQRACQTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1681 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctgactgtagaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1682 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1683 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggacggcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1684 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGRQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1685 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccggcttattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1686 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPAYWEEISDAALARVSERYTWERYAERLMTIARCFGFWRFVLSRESQVMERYLQMFRHLQWRPLAHAVPME

SEQ ID NO: 1687 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcaggaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1688 - protein, 793 aa, Artificial Sequence
  Variant of sucrose synthase
MIEELRQQLLDSPRSWRAFLRHLVASQRDSWLHTDLQRACKTFREQPPEGYQEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1689 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaactgatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1690 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYATDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1691 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctgatggattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1692 - protein, 793 aa, Artificial Sequence
  Variant of sucrose synthase
MIEELRQQLLDSPRSWRAFLRHLVASQRDSWLHTDLQRACKTFREQPPEGYPEDIGWLMDFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1693 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttctggaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1694 - protein, 793 aa, Artificial Sequence
  Variant of sucrose synthase
MIEELRQQLLDSPRSWRAFLRHLVASQRDSWLHTDLQRACKTFLEQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1695 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1696 - protein, 793 aa, Artificial Sequence
  Variant of sucrose synthase
MIEELRQQLLDSPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1697 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1698 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYQDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1699 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctattctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1700 - protein, 793 aa, Artificial Sequence
  Variant of sucrose synthase
MIEELRQQLLDSPRSWRAFLRHLVASQRDSWLHTDLQRACKTFREQPPEGYSEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1701 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttactgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1702 - protein, 793 aa, Artificial Sequence
  Variant of sucrose synthase
MIEELRQQLLDSPRSWRAFLRHLVASQRDSWLHTDLQRACKTFTEQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1703 - DNA, 2379 bp, Artificial Sequence
  Variant of sucrose synthase
atgattgaaacgctgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1704 - protein, 793 aa, Artificial Sequence
  Variant of sucrose synthase
MIETLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1705 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacaggcgccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1706 - protein, 793 aa, Artificial Sequence
  Variant of sucrose synthase
MIEELRQQLLDSPRSWRAFLRHLVASQRDSWLHTDLQRACKTFREQAPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1707 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtacgtgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1708 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGTWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1709 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctgtcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1710 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLSVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1711 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccattgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1712 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTIVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1713 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctataccgaagatattggttggctggctgattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1714 - protein, 793 aa, Artificial Sequence
  Variant of sucrose synthase
MIEELRQQLLDSPRSWRAFLRHLVASQRDSWLHTDLQRACKTFREQPPEGYTEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1715 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcggccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1716 - protein, 793 aa, Artificial Sequence
  Variant of sucrose synthase
MIEELRQQLLDSPRSWRAFLRHLVASQRDSWLHTDLQRACKTFREQRPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1717 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcctgggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1718 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVLGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1719 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgctttccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1720 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLLSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1721 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcttgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1722 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLILSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1723 - DNA, 2379 bp, Artificial Sequence
  Variant of sucrose synthase
atgattgaacagctgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1724 - protein, 793 aa, Artificial Sequence
  Variant of sucrose synthase
MIEQLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1725 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccctggtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1726 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTLVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1727 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctgactgattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1728 - protein, 793 aa, Artificial Sequence
  Variant of sucrose synthase
MIEELRQQLLDSPRSWRAFLRHLVASQRDSWLHTDLQRACKTFREQPPEGYPEDIGWLTDFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1729 - DNA, 2379 bp, Artificial Sequence
  Variant of sucrose synthase
atgattgaagaactgcgccaacagctgctggataagccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1730 - protein, 793 aa, Artificial Sequence
  Variant of sucrose synthase
MIEELRQQLLDKPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1731 - DNA, 2379 bp, Artificial Sequence
  Variant of sucrose synthase
atgattggagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtagggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1732 - protein, 793 aa, Artificial Sequence
  Variant of sucrose synthase
MIGELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGRDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1733 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttgcggaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1734 - protein, 793 aa, Artificial Sequence
  Variant of sucrose synthase
MIEELRQQLLDSPRSWRAFLRHLVASQRDSWLHTDLQRACKTFAEQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1735 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttcacggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1736 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFTDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1737 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccaacgatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1738 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPTIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1739 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttccaggattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1740 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFQDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1741 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtcagctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1742 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRQLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1743 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgacgaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1744 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVTNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1745 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggataagatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1746 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDKIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1747 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagccgtgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1748 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISRVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1749 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggtcatctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1750 - protein, 793 aa, Artificial Sequence
  Variant of sucrose synthase
MIEELRQQLLDSPRSWRAFLRHLVASQRDSWLHTDLQRACKTFREQPPEGYPEDIGHLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1751 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcagagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1752 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPQSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1753 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttatctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1754 - protein, 793 aa, Artificial Sequence
  Variant of sucrose synthase
MIEELRQQLLDSPRSWRAFLRHLVASQRDSWLHTDLQRACKTFREQPPEGYPEDIGYLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1755 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgactctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1756 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSTLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1757 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgctgttattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1758 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRCYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1759 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaggtgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1760 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLGDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1761 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaagagtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1762 - protein, 793 aa, Artificial Sequence
  Variant of sucrose synthase
MIEELRQQLLDSPRSWRAFLRHLVASQRDSWLHTDLQRACKEFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1763 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtgcggatgcagaagaacgcgaagaaatccgtcgtatgcacgagatcatggaccattaccagctggatggtcagatgcgttgggtgggatcgcagctggataaaaccgtcgttggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1764 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSADAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1765 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacaggggccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1766 - protein, 793 aa, Artificial Sequence
  Variant of sucrose synthase
MIEELRQQLLDSPRSWRAFLRHLVASQRDSWLHTDLQRACKTFREQGPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1767 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggattatcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1768 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADYRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1769 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtcatcgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1770 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRHRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1771 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaacctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1772 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEPVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1773 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatcctgatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1774 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1775 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatcgtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1776 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADRRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1777 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattggcatgaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1778 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWHEISDAALARVSERYTWERYAERLMTIARCFGFWRFVLSRESQVMERYLQMFRHLQWRPLAHAVPME

SEQ ID NO: 1779 - DNA, 2379 bp, Artificial Sequence
  Variant of sucrose synthase
atgattgaagaactgcgccttcagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1780 - protein, 793 aa, Artificial Sequence
  Variant of sucrose synthase
MIEELRLQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1781 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggaggtcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1782 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGGQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1783 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttgcggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1784 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVAAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1785 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaatttttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1786 - protein, 793 aa, Artificial Sequence
  Variant of sucrose synthase
MIEELRQQLLDSPRSWRAFLRHLVASQRDSWLHTDLQRACKIFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1787 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtgcaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcgcggaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1788 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVAERYTWERYAERLMTIARCFGFWRFVLSRESQVMERYLQMFRHLQWRPLAHAVPME

SEQ ID NO: 1789 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagctgcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1790 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAELREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1791 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatcacgcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1792 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEITRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1793 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatattgaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1794 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHIEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1795 - DNA, 2379 bp, Artificial Sequence
  Variant of sucrose synthase
atgattgaagaactgcgccatcagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1796 - protein, 793 aa, Artificial Sequence
  Variant of sucrose synthase
MIEELRHQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1797 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1798 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFQDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1799 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcggagctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1800 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSELWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1801 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgtcgctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1802 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLSLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1803 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtccgcgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1804 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRPRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1805 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctattctcgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1806 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYSRTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1807 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttcgtgccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1808 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVRAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1809 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagactccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1810 - protein, 793 aa, Artificial Sequence
  Variant of sucrose synthase
MIEELRQQLLDSPRSWRAFLRHLVASQRDSWLHTDLQRACKTFREQTPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1811 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttagtgccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1812 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVSAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1813 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtcagcgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1814 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRQRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1815 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgatgaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1816 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVMNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1817 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtccggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1818 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSPDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1819 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttattgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1820 - protein, 793 aa, Artificial Sequence
  Variant of sucrose synthase
MIEELRQQLLDSPRSWRAFLRHLVASQRDSWLHTDLQRACKTFIEQPPEGYVEDIGWLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1821 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1822 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1823 - DNA, 2379 bp, Artificial Sequence
  Variant of sucrose synthase
atgattgaagaactgcgccaacagctgctggatagcccgcgttcatggcgtgcattcctgcgtcatttagtcacatctcagcgtgactcatggttacatacggatttacagcgcgcgtgcaagacgtttattgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1824 - protein, 793 aa, Artificial Sequence
  Variant of sucrose synthase
MIEELRQQLLDSPRSWRAFLRHLVTSQRDSWLHTDLQRACKTFIEQPPEGYGEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1825 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1826 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1827 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1828 - protein, 793 aa, Artificial Sequence
  Variant of sucrose synthase
MIEELRQQLLDSPRSWRAFLRHLVASQRDSWLHTDLQRACSTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1829 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1830 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1831 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttattgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccgcaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1832 - protein, 793 aa, Artificial Sequence
  Variant of sucrose synthase
MIEELRQQLLDSPRSWRAFLRHLVASQRDSWLHTDLQRACKTFIEQPPEGYPEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPQSDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1833 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccgcgcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1834 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPRSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1835 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1836 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1837 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1838 - protein, 793 aa, Artificial Sequence
  Variant of sucrose synthase
MIEELRQQLLDSPRSWRAFLRHLVASQRDSWLHTDLQRACSTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1839 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttattgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgattcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1840 - protein, 793 aa, Artificial Sequence
  Variant of sucrose synthase
MIEELRQQLLDSPRSWRAFLRHLVASQRDSWLHTDLQRACKTFIEQPPEGYVEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1841 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatgttgaagatattggttggctggcagattttgtggcacatacccaggaagcgatcttccgggatccgtggatggtttttgcgtggcgtctacgtccaggtgtttgggagtatgtgcgaatacatgtagaacagctggcggtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1842 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1843 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgctctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1844 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGALEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1845 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1846 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1847 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1848 - protein, 793 aa, Artificial Sequence
  Variant of sucrose synthase
MIEELRQQLLDSPRSWRAFLRHLVASQRDSWLHTDLQRACSTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1849 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1850 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1851 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1852 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1853 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1854 - protein, 793 aa, Artificial Sequence
  Variant of sucrose synthase
MIEELRQQLLDSPRSWRAFLRHLVASQRDSWLHTDLQRACSTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1855 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1856 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1857 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1858 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1859 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1860 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1861 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttattgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgctctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1862 - protein, 793 aa, Artificial Sequence
  Variant of sucrose synthase
MIEELRQQLLDSPRSWRAFLRHLVASQRDSWLHTDLQRACKTFIEQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGALEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1863 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttattgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcaacgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1864 - protein, 793 aa, Artificial Sequence
  Variant of sucrose synthase
MIEELRQQLLDSPRSWRAFLRHLVASQRDSWLHTDLQRACSTFIEQPPEGYGEDIGWLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEATRERPSYWEEISDAALARVSERYTWERYAERLMTIARCFGFWRFVLSRESQVMERYLQMFRHLQWRPLAHAVPME

SEQ ID NO: 1865 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgagaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1866 - protein, 793 aa, Artificial Sequence
  Variant of sucrose synthase
MIEELRQQLLDSPRSWRAFLRHLVASQRDSWLHTDLQRACSTFREQPPEGYVEDIGWLADFVAHTQEAIFRDPWMVFAWRLRPGVWEYVRIHVEQLAVEELSTDEYLQAKEQLVGLGAEGEAVLTVDFEDFRPRSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1867 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttattgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1868 - protein, 793 aa, Artificial Sequence
  Variant of sucrose synthase
MIEELRQQLLDSPRSWRAFLRHLVASQRDSWLHTDLQRACKTFIEQPPEGYVEDIGWLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1869 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1870 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1871 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1872 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1873 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttattgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtgagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1874 - protein, 793 aa, Artificial Sequence
  Variant of sucrose synthase
MIEELRQQLLDSPRSWRAFLRHLVASQRDSWLHTDLQRACSTFIEQPPEGYGEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1875 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1876 - protein, 793 aa, Artificial Sequence
  Variant of sucrose synthase
MIEELRQQLLDSPRSWRAFLRHLVASQRDSWLHTDLQRACSTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1877 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1878 - protein, 793 aa, Artificial Sequence
  Variant of sucrose synthase
MIEELRQQLLDSPRSWRAFLRHLVASQRDSWLHTDLQRACSTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1879 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1880 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1881 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1882 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1883 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1884 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1885 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccgcaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1886 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPQSDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1887 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1888 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1889 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttattgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1890 - protein, 793 aa, Artificial Sequence
  Variant of sucrose synthase
MIEELRQQLLDSPRSWRAFLRHLVASQRDSWLHTDLQRACSTFIEQPPEGYPEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1891 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1892 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPRSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1893 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1894 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLTVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1895 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1896 - protein, 793 aa, Artificial Sequence
  Variant of sucrose synthase
MIEELRQQLLDSPRSWRAFLRHLVASQRDSWLHTDLQRACSTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1897 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgtacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1898 - protein, 793 aa, Artificial Sequence
  Variant of sucrose synthase
MIEELRQQLLDSPRSWRAFLRHLVASQRDSWLHTDLQRACSTFREQPPEGYVEDIGWLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1899 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1900 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1901 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1902 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1903 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccgcaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1904 - protein, 793 aa, Artificial Sequence
  Variant of sucrose synthase
MIEELRQQLLDSPRSWRAFLRHLVASQRDSWLHTDLQRACSTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPQSDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1905 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgctctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1906 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPRSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGALEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1907 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1908 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLTVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1909 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttattgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1910 - protein, 793 aa, Artificial Sequence
  Variant of sucrose synthase
MIEELRQQLLDSPRSWRAFLRHLVASQRDSWLHTDLQRACKTFIEQPPEGYPEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1911 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgagaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgctctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1912 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGALEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1913 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccgcgcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgctctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1914 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPRSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGALEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1915 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttattgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1916 - protein, 793 aa, Artificial Sequence
  Variant of sucrose synthase
MIEELRQQLLDSPRSWRAFLRHLVASQRDSWLHTDLQRACSTFIEQPPEGYVEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1917 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1918 - protein, 793 aa, Artificial Sequence
  Variant of sucrose synthase
MIEELRQQLLDSPRSWRAFLRHLVASQRDSWLHTDLQRACSTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1919 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1920 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1921 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1922 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1923 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttattgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccgcaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1924 - protein, 793 aa, Artificial Sequence
  Variant of sucrose synthase
MIEELRQQLLDSPRSWRAFLRHLVASQRDSWLHTDLQRACSTFIEQPPEGYPEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPQSDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1925 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttattgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1926 - protein, 793 aa, Artificial Sequence
  Variant of sucrose synthase
MIEELRQQLLDSPRSWRAFLRHLVASQRDSWLHTDLQRACSTFIEQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1927 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgagtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1928 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1929 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1930 - protein, 793 aa, Artificial Sequence
  Variant of sucrose synthase
MIEELRQQLLDSPRSWRAFLRHLVASQRDSWLHTDLQRACSTFREQPPEGYGEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1931 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgctctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1932 - protein, 793 aa, Artificial Sequence
  Variant of sucrose synthase
MIEELRQQLLDSPRSWRAFLRHLVASQRDSWLHTDLQRACSTFREQPPEGYPEDIGWLADFVAHTQEAIFRDPWMVFAWRLRPGVWEYVRIHVEQLTVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGALEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1933 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgctctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1934 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGALEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1935 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1936 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1937 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1938 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1939 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1940 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1941 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1942 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1943 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccgcgcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1944 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPRSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1945 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccgcgcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1946 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPRSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1947 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1948 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1949 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1950 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1951 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccgcaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1952 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPQSDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1953 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1954 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1955 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1956 - protein, 793 aa, Artificial Sequence
  Variant of sucrose synthase
MIEELRQQLLDSPRSWRAFLRHLVASQRDSWLHTDLQRACSTFREQPPEGYPEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1957 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttattgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1958 - protein, 793 aa, Artificial Sequence
  Variant of sucrose synthase
MIEELRQQLLDSPRSWRAFLRHLVASQRDSWLHTDLQRACSTFIEQPPEGYGEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1959 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccgcgcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1960 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLTVEELSTDEYLQAKEQLVGLGAEGEAVLTVDFEDFRPRSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1961 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1962 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1963 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1964 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1965 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgctctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1966 - protein, 793 aa, Artificial Sequence
  Variant of sucrose synthase
MIEELRQQLLDSPRSWRAFLRHLVASQRDSWLHTDLQRACKTFREQPPEGYGEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGALEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1967 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggctgtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1968 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1969 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1970 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1971 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttattgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccgcaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1972 - protein, 793 aa, Artificial Sequence
  Variant of sucrose synthase
MIEELRQQLLDSPRSWRAFLRHLVASQRDSWLHTDLQRACKTFIEQPPEGYGEDIGWLADFVAHTQEAIFRDPWMVFAWRLRPGVWEYVRIHVEQLAVEELSTDEYLQAKEQLVGLGAEGEAVLTVDFEDFRPRSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPQSDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1973 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1974 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPRSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1975 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccgcgcagcgggcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1976 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLTVEELSTDEYLQAKEQLVGLGAEGEAVLTVDFEDFRPRSGRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1977 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttgtctggcagattttgtggcacatacccaggaagcgatcttccgggatccgtggatggtttttgcgtggcgtctacgtccaggtgtttgggagtatgtgcgcatacatgtagaacagctgactgtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1978 - protein, 793 aa, Artificial Sequence
  Variant of sucrose synthase
MIEELRQQLLDSPRSWRAFLRHLVASQRDSWLHTDLQRACKTFREQPPEGYPEDIGCLADFVAHTQEAIFRDPWMVFAWRLRPGVWEYVRIHVEQLTVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1979 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1980 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1981 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccgcaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggatcatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1982 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPQSDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1983 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatgttgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1984 - protein, 793 aa, Artificial Sequence
  Variant of sucrose synthase
MIEELRQQLLDSPRSWRAFLRHLVASQRDSWLHTDLQRACKTFREQPPEGYVEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1985 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgatatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtatctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1986 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSYLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1987 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcagcacgtttcgtgaacagcctccggaaggctatggtgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccgcgcagccaacgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtactccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1988 - protein, 793 aa, Artificial Sequence
  Variant of sucrose synthase
MIEELRQQLLDSPRSWRAFLRHLVASQRDSWLHTDLQRACSTFREQPPEGYGEDIGWLADFVAHTQEAIFRDPWMVFAWRLRPGVWEYVRIHVEQLAVEELSTDEYLQAKEQLVGLGAEGEAVLTVDFEDFRPRSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARCFGFWRFVLSRESQVMERYLQMFRHLQWRPLAHAVPME

SEQ ID NO: 1989 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacaggtggcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1990 - protein, 793 aa, Artificial Sequence
  Variant of sucrose synthase
MIEELRQQLLDSPRSWRAFLRHLVASQRDSWLHTDLQVACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1991 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagttggcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1992 - protein, 793 aa, Artificial Sequence
  Variant of sucrose synthase
MIEELRQQLLDSPRSWRAFLRHLVASQRDSWLHTDLQLACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1993 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggccatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1994 - protein, 793 aa, Artificial Sequence
  Variant of sucrose synthase
MIEELRQQLLDSPRSWRAFLRHLVASQRDSWLHTDLQRACKTFREQPPEGHPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1995 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagaatgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1996 - protein, 793 aa, Artificial Sequence
  Variant of sucrose synthase
MIEELRQQLLDSPRSWRAFLRHLVASQRDSWLHTDLQNACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1997 - DNA, 2379 bp, Artificial Sequence
  Variant of sucrose synthase
atgattgaagtgctgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 1998 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 1999 - DNA, 2379 bp, Artificial Sequence
  Variant of sucrose synthase
atgattgaagaactgcgccaacagctgctggatagcccgcgttcatggcgtgcattcctgcgtacgttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2000 - protein, 793 aa, Artificial Sequence
  Variant of sucrose synthase
MIEELRQQLLDSPRSWRAFLRTLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2001 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggcgcgcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2002 - protein, 793 aa, Artificial Sequence
  Variant of sucrose synthase
MIEELRQQLLDSPRSWRAFLRHLVASQRDSWLHTDLQRACKTFREQPPEGAPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2003 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagtctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccagaattatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2004 - protein, 793 aa, Artificial Sequence
  Variant of sucrose synthase
MIEELRQQLLDSPRSWRAFLRHLVASQRDSWLHTDLQRACKTFREQSPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQNYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2005 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2006 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2007 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatgaggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2008 - protein, 793 aa, Artificial Sequence
  Variant of sucrose synthase
MIEELRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2009 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttattgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2010 - protein, 793 aa, Artificial Sequence
  Variant of sucrose synthase
MIEELRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2011 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatagtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2012 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWIVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2013 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggaggtgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2014 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEEVSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2015 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagtgggcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2016 - protein, 793 aa, Artificial Sequence
  Variant of sucrose synthase
MIEELRQQLLDSPRSWRAFLRHLVASQRDSWLHTDLQWACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2017 - DNA, 2379 bp, Artificial Sequence
  Variant of sucrose synthase
atgattgaagaactgcgccaacagctgctggatagcccgcgttcatggcgtgcattcctgcgtctgttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2018 - protein, 793 aa, Artificial Sequence
  Variant of sucrose synthase
MIEELRQQLLDSPRSWRAFLRLLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2019 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgacaagttacgtcaaaccgtacaatatctgggcaccttaccaagagaaactccgtggacagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2020 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDKLRQTVQYLGTLPRETPWTEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2021 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggtcgcatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2022 - protein, 793 aa, Artificial Sequence
  Variant of sucrose synthase
MIEELRQQLLDSPRSWRAFLRHLVASQRDSWSHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2023 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2024 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSEILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2025 - DNA, 2379 bp, Artificial Sequence
  Variant of sucrose synthase
atgattgcggaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2026 - protein, 793 aa, Artificial Sequence
  Variant of sucrose synthase
MIAELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2027 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggcacgcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2028 - protein, 793 aa, Artificial Sequence
  Variant of sucrose synthase
MIEELRQQLLDSPRSWRAFLRHLVASQRDSWLHTDLQRACKTFREQPPEGTPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2029 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaacatgcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2030 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEHARERPKYWEEISDAALARVSERYTWERYAERLMTIARCFGFWRFVLSRESQVMERYLQMFRHLQWRPLAHAVPME

SEQ ID NO: 2031 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaaaacgtttcgcgaacagcctccggaaggccatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2032 - protein, 793 aa, Artificial Sequence
  Variant of sucrose synthase
MIEELRQQLLDSPRSWRAFLRHLVASQRDSWLHTDLQRACKTFREQPPEGHPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2033 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacattctgatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2034 - protein, 793 aa, Artificial Sequence
  Variant of sucrose synthase
MIEELRQQLLDSPRSWRAFLRHLVASQRDSWLHSDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2035 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2036 - protein, 793 aa, Artificial Sequence
  Variant of sucrose synthase
MIEELRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2037 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2038 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2039 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2040 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2041 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2042 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2043 - DNA, 2379 bp, Artificial Sequence
  Variant of sucrose synthase
atgattgaagaactgcgccaacagctgctggatagcccgcgttcatggcgtgcattcctgcgtctgttagtcgcatctcagcgtgactcatggttacatagtgatttacagcgtgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2044 - protein, 793 aa, Artificial Sequence
  Variant of sucrose synthase
MIEELRQQLLDSPRSWRAFLRLLVASQRDSWLHSDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2045 - DNA, 2379 bp, Artificial Sequence
  Variant of sucrose synthase
atgattgaagtactgcgccaacagctgctggatagcccgcgttcatggcgtgcattcctgcgtctgttagtcgcatctcagcgtgactcatggttacatacggatttacagcgcgcgtgcaagacgtttcgtgaacagccgccggaaggcgcgcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctaggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2046 - protein, 793 aa, Artificial Sequence
  Variant of sucrose synthase
MIEVLRQQLLDSPRSWRAFLRLLVASQRDSWLHTDLQRACKTFREQPPEGAPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2047 - DNA, 2379 bp, Artificial Sequence
  Variant of sucrose synthase
atgattgaagaactgcgccaacagctgctggatagcccgcgttcatggcgtgcattcctgcgtactttagtcgcatctcagcgtgactcatggttacatgaggatttacagcgtgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggaggtgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2048 - protein, 793 aa, Artificial Sequence
  Variant of sucrose synthase
MIEELRQQLLDSPRSWRAFLRTLVASQRDSWLHEDLQRACKTFREQPPEGYPEDIGWLADFVAHTQEAIFRDPWMVFAWRLRPGVWEYVRIHVEQLAVEEVSTDEYLQAKEQLVGLGAEGEAVLTVDFEDFRPVSQRLKDESTIGDGLTHLNRHLAGRIWTDLAAGRSEILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2049 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatagtgatttacagctggcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2050 - protein, 793 aa, Artificial Sequence
  Variant of sucrose synthase
MIEELRQQLLDSPRSWRAFLRHLVASQRDSWLHSDLQLACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2051 - DNA, 2379 bp, Artificial Sequence
  Variant of sucrose synthase
atgattgaagtactgcgccaacagctgctggatagcccgcgttcatggcgtgcattcctgcgtactttagtcgcatctcagcgtgactcatggttacatgaggatttacagaatgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2052 - protein, 793 aa, Artificial Sequence
  Variant of sucrose synthase
MIEVLRQQLLDSPRSWRAFLRTLVASQRDSWLHEDLQNACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2053 - DNA, 2379 bp, Artificial Sequence
  Variant of sucrose synthase
atgattgaagtactgcgccaacagctgctggatagcccgcgttcatggcgtgcattcctgcgtctgttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggaggtgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggattatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2054 - protein, 793 aa, Artificial Sequence
  Variant of sucrose synthase
MIEVLRQQLLDSPRSWRAFLRLLVASQRDSWLHTDLQRACKTFREQPPEGYPEDIGWLADFVAHTQEAIFRDPWMVFAWRLRPGVWEYVRIHVEQLAVEEVSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2055 - DNA, 2379 bp, Artificial Sequence
  Variant of sucrose synthase
atgattgaagtactgcgccaacagctgctggatagcccgcgttcatggcgtgcattcctgcgtctgttagtcgcatctcagcgtgactcatggttacatgaggatttacagcgtgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgacagtttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2056 - protein, 793 aa, Artificial Sequence
  Variant of sucrose synthase
MIEVLRQQLLDSPRSWRAFLRLLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2057 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagcgtgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgacagtttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2058 - protein, 793 aa, Artificial Sequence
  Variant of sucrose synthase
MIEVLRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2059 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgacagtttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2060 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2061 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2062 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2063 - DNA, 2379 bp, Artificial Sequence
  Variant of sucrose synthase
atgattgaagaactgcgccaacagctgctggatagcccgcgttcatggcgtgcattcctgcgtactttagtcgcatctcagcgtgactcatggttacatgaggatttacagcgtgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggaggtgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgagattctggaatttctgggcctgcatcgtctggataaccagaatctgatgctgagcaacggcaataccgattttgacaaattacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2064 - protein, 793 aa, Artificial Sequence
  Variant of sucrose synthase
MIEELRQQLLDSPRSWRAFLRTLVASQRDSWLHEDLQRACKTFREQPPEGYPEDIGWLADFVAHTQEAIFRDPWMVFAWRLRPGVWEYVRIHVEQLAVEEVSTDEYLQAKEQLVGLGAEGEAVLTVDFEDFRPVSQRLKDESTIGDGLTHLNRHLAGRIWTDLAAGRSEILEFLGLHRLDNQNLMLSNGNTDFDKLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2065 - DNA, 2379 bp, Artificial Sequence
  Variant of sucrose synthase
atgattgaagaactgcgccaacagctgctggatagcccgcgttcatggcgtgcattcctgcgtactttagtcgcatctcagcgtgactcatggttacatacggatttacagcgcgcgtgcaagacgtttcgtgaacagtcgccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2066 - protein, 793 aa, Artificial Sequence
  Variant of sucrose synthase
MIEELRQQLLDSPRSWRAFLRTLVASQRDSWLHTDLQRACKTFREQSPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2067 - DNA, 2379 bp, Artificial Sequence
  Variant of sucrose synthase
atgattgaagtactgcgccaacagctgctggatagcccgcgttcatggcgtgcattcctgcgtactttagtcgcatctcagcgtgactcatggttacatacggatttacagcgcgcgtgcaagacgtttcgtgaacagcctccggaaggctatcctgaagatattggttggctggcagattttgtcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2068 - protein, 793 aa, Artificial Sequence
  Variant of sucrose synthase
MIEVLRQQLLDSPRSWRAFLRTLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2069 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatcgtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2070 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWIVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2071 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatgaggatttacagcgtgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggaggtgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2072 - protein, 793 aa, Artificial Sequence
  Variant of sucrose synthase
MIEELRQQLLDSPRSWRAFLRHLVASQRDSWLHEDLQRACKTFREQPPEGYPEDIGWLADFVAHTQEAIFRDPWMVFAWRLRPGVWEYVRIHVEQLAVEEVSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2073 - DNA, 2379 bp, Artificial Sequence
  Variant of sucrose synthase
atgattgaagtactgcgccaacagctgctggatagcccgcgttcatggcgtgcattcctgcgtactttagtcgcatctcagcgtgactcatggttacatgaggatttacaggtggcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2074 - protein, 793 aa, Artificial Sequence
  Variant of sucrose synthase
MIEVLRQQLLDSPRSWRAFLRTLVASQRDSWLHEDLQVACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2075 - DNA, 2379 bp, Artificial Sequence
  Variant of sucrose synthase
atgattgaagaactgcgccaacagctgctggatagcccgcgttcatggcgtgcattcctgcgtctgttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatcgtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2076 - protein, 793 aa, Artificial Sequence
  Variant of sucrose synthase
MIEELRQQLLDSPRSWRAFLRLLVASQRDSWLHTDLQRACKTFREQPPEGYPEDIGWLADFVAHTQEAIFRDPWIVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2077 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgctattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2078 - protein, 793 aa, Artificial Sequence
  Variant of sucrose synthase
MIEVLRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSAILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

SEQ ID NO: 2079 - DNA, 2379 bp, Artificial Sequence
  Variant of sucrose synthase
atgattgaagtactgcgccaacagctgctggatagcccgcgttcatggcgtgcattcctgcgtcatttagtcgcatctcagcgtgactcatggttacatgaggatttacagaatgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggaggtgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2080 - protein, 793 aa, Artificial Sequence
  Variant of sucrose synthase
MIEVLRQQLLDSPRSWRAFLRHLVASQRDSWLHEDLQNACKTFREQPPEGYPEDIGWLADFVAHTQEAIFRDPWMVFAWRLRPGVWEYVRIHVEQLAVEEVSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2081 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatgaggatttacagcgtgcgtgcaagacgtttcgtgaacagcctccggaaggctatcctgaagatattggttggctggcagattttatcgcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtgagattctggaatttctgggcctgcatcgtctggataaccagaatctgatgctgagcaacggcaataccgattttgactctttacgtcaaaccgtacaatatctgggcaccttaccaagagaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacccggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgacggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2082 - protein, 793 aa, Artificial Sequence
  Variant of sucrose synthase
MIEELRQQLLDSPRSWRAFLRHLVASQRDSWLHEDLQRACKTFREQPPEGYPEDIGWLADFIAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSEILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYPGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARCFGFWRFVLSRESQVMERYLQMFRHLQWRPLAHAVPME

SEQ ID NO: 2083 - DNA, 2379 bp, Artificial Sequence
  Variant of sucrose synthase
atgattgaagaactgcgccaacagctgctggatagcccgcgttcatggcgtgcattcctgcgtcatttagtcgcatctcagcgtgactcatggttacatacggatttacagcgcgcgtgcaagacgtttcgtgaacagcctccggaaggctatcctgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgacaaattacgtcaaaccgtacaatatctgggcaccttaccaagagaaactccgtgggcggagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcaagggatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctggggtccgatctgcattggccggattatgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatccgcgcacgtattttagctatgcccgtactgaagaacgcttctcgtcgctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtgcagaatagtatggatgcagaagaacgcgaagaaatccgtcgtatgcacgagatcatggaccattaccagctggatggtcagatgcgttgggtgggatcgcagctggataaaaccgtcgtgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcggtggcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgttgcttcggcttttggcgcttcgttctgtcacgcgaatcacaggtcatggaacgctatctgcaaatgttccgccacctgcaatggcgcccgctggctcatgccgtaccgatggag

SEQ ID NO: 2084 - protein, 793 aa, Artificial Sequence
  Variant of sucrose synthase
MIEELRQQLLDSPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDKLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYARDLEREVKAELGSRPDLIIGNYSDGNLVATLLSEKLGVTQCNIAHALEKSKYLGSDLHWPDYEQDHHFACQFTADLIAMNAADIIVTSTYQEIAGNDREVGQYESHQDYTLPGLYRVENGIDVFDSKFNIVSPGADPRTYFSYARTEERFSSLWPEIESLLFGREPGPDIRGVLEDRQKPIILSMARMDRIKNLSGLAELYGRSSRLRSLANLVIIGGHVDVQNSMDAEEREEIRRMHEIMDHYQLDGQMRWVGSQLDKTVVGELYRVVADGRGVFVQPALFEAFGLTVIEAMSSGLPVFATRHGGPLEIIEDGVSGFHIDPNDPEAVAEKLADFLEAARERPKYWEEISDAALARVSERYTWERYAERLMTIARCFGFWRFVLSRESQVMERYLQMFRHLQWRPLAHAVPME

(The sequence listing continues in the following parts.)

We claim:

1. An engineered glycosyltransferase comprising a polypeptide sequence that has at least 90%, 91%, 92%, 93%, 94%, 95%, 96%, 97%, 98%, 99%, or more sequence identity to SEQ ID NO: 20, 36, 174, 406, 408, 440, 520, 626, or 678, wherein said polypeptide sequence comprises one or more mutations relative to the reference sequence of SEQ ID NO: 20, 36, 174, 406, 408, 440, 520, 626, or 678.

2. The engineered glycosyltransferase of claim 1, wherein said polypeptide sequence of said engineered glycosyltransferase comprises at least one mutation or mutation set at one or more positions selected from 41/72/233/338, 41/72/338, 41/144/233, 41/233, 41/233/338, 61, 61/87/91/107, 61/87/91/259, 61/91/431, 61/107, 61/259/428, 61/407/428, 61/411, 72, 72/76, 72/76/163/197, 72/76/195/233, 72/76/197/204, 72/76/207/233, 72/76/207/338, 72/81, 72/81/195/233, 72/139/195/204, 72/144/338, 72/200/204/207, 72/207, 76/144/197/200, 76/195/197/204/207/233, 76/197/207/233, 76/233, 81/139/144/195/200/204/207/233, 81/144/233, 81/197/200/207/233/338, 81/233/338, 81/338, 107, 107/259, 139/144/233, 144/233, 144/233/338, 156/407, 163/233/338, 200/204/207/233, 233/338, and 259, wherein said positions are numbered with reference to SEQ ID NO: 20.

3. The engineered glycosyltransferase of claim 1, wherein said polypeptide sequence of said engineered glycosyltransferase comprises at least one mutation or mutation set at one or more positions selected from 71, 80, 81, 81/270, 83, 85, 97, 124, 263, 286, 334, 402, 420, and 456, wherein said positions are numbered with reference to SEQ ID NO: 20.

4. The engineered glycosyltransferase of claim 1, wherein said polypeptide sequence of said engineered glycosyltransferase comprises at least one mutation or mutation set at one or more positions selected from 41/72/233/338, 41/72/338, 61, 61/91/431, 61/259/428, 61/407/428, 81/139/144/195/200/204/207/233, and 81/197/200/207/233/338, wherein said positions are numbered with reference to SEQ ID NO: 20.

5. The engineered glycosyltransferase of claim 1, wherein said polypeptide sequence of said engineered glycosyltransferase comprises at least one mutation or mutation set at one or more positions selected from 153, 153/326, 153/326/443, 153/326/443/455, 232, 232/273/299, 232/393/451, 299/451, 326, 404, and 451, wherein said positions are numbered with reference to SEQ ID NO: 408.

6. The engineered glycosyltransferase of claim 1, wherein said polypeptide sequence of said engineered glycosyltransferase comprises at least one mutation or mutation set at one or more positions selected from 25, 116, 146, 170, 173, 227, 296, 300, 315, 327, 330, 361, 408, 412, 438, 448, and 449, wherein said positions are numbered with reference to SEQ ID NO: 408.

7. The engineered glycosyltransferase of claim 1, wherein said polypeptide sequence of said engineered glycosyltransferase comprises at least one mutation or mutation set at one or more positions selected from 153, 232, 232/393/451, and 451, wherein said positions are numbered with reference to SEQ ID NO: 408.

8. The engineered glycosyltransferase of claim 1, wherein said engineered glycosyltransferase is an NDP-glycosyltransferase selected from ADP-glucose-dependent glycosyltransferases (AGTs), CDP-glucose-dependent glycosyltransferases (CGTs), GDP-glucose-dependent glycosyltransferase (GGTs), TDP-glucose-dependent glycosyltransferases (TGTs), and IDP-glucose-dependent glycosyltransferase (IGTs).

9. The engineered glycosyltransferase of claim 8, wherein said engineered glycosyltransferase is an ADP-glucose-dependent glycosyltransferase.

10. The engineered glycosyltransferase of claim 1, wherein said engineered glycosyltransferase enzymatically transfers glycosyl residues from an activated sugar donor other than uracil-diphosphate-glucose.

11. A composition comprising at least one engineered glycosyltransferase of claim 1.

12. The engineered glycosyltransferase of claim 1, wherein said polypeptide sequence of said engineered glycosyltransferase comprises SEQ ID NO: 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, or 856.

13. An engineered polynucleotide encoding at least one engineered glycosyltransferase polypeptide provided in claim 1.

14. A vector comprising at least one engineered polynucleotide of claim 13.

15. The vector of claim 14, wherein said vector further comprises at least one control sequence.

16. A host cell comprising at least one engineered polynucleotide of claim 13.

17. A host cell comprising at least one vector of claim 14.

18. The host cell of claim 16, wherein said host cell is an eukaryotic or prokaryotic cell.

19. A method for producing at least one engineered glycosyltransferase, comprising culturing the host cell of claim 16, under conditions such that said engineered glycosyltransferase is produced by said host cell.

20. The method of claim 19, further comprising the step of recovering said engineered glycosyltransferase.

* * * * *